United States Patent 7,833,706 (GENETIC POLYMORPHISMS ASSOCIATED WITH RHEUMATOID ARTHRITIS, METHODS OF DETECTION AND USES THEREOF) - sequence listing, part 8

SEQ ID NO: 10752 - DNA, 38449 bp, Homo sapiens
  misc_feature (1)...(38449): n = A,T,C or G, or insertion/deletion polymorphism (see Tables 1-2)
caaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcggcattagatcggaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacaygtaagaattggaggaaaataaakgtggatttgggaaactttgaggccagcttgcttcttgcaggctcatgatcaaccaatctcacataaaagtattgaatgttacatatctcagccttcttgatagggatttcatagattttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatgacaaaattawtttgtccttrtatttgtaaatggtagcaatgggcatgatttcagtcctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgtygtaaaagagatgrtagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaaggtgggtaggaacaaacaaatttattgtggtttaaaaattggaggagggggraaaagcctgagggaaagataagtttgggtgkagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtaygcataggaayccttagaaggactcaaaaacacctggactttaatagggaagagrataggttgtaagcagaagttgggaaacataacttgtgggaaaaartaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggrrcctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcrgcctcccagaaaaccagagctgctacaggaggtaagggatgggtttgagattgtgcttcactgcactcttactcgtgaaawttcttctgggttatgttttctctgttytctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcntacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggmtttctcccttcaggggctcctgcccagcaggtatattgtatcktcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagacgcccttcttcccttaggtcctyctctggcctcaattcccgtctsaaggccacgccttccacctacagtggagtcttccgcacccagcgcgtcgacctttaccagcaggtgaaggagaaacccttgtggccccaactctaaattygagttgccacytgatttcctgtccttccrtctcatcgctgacctctcactgtgactcactstttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacatcaggctgggcgcggtggcccacgcctgtaattccagcactttgggaggccaaggcgggtggatcacaaggtcaggagttcgagaccagcctggccaatatggtgaaaccctgtctctactaaaaatacaaaaattagccgggcgtggtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagyaagcaggttggagaaasgctggccaagtcccyatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccacttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccrgcgccctgctggatagagagcaagggagaayttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccacatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccgatctcagatgatccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagt

SEQ ID NO: 10753 - DNA, 24841 bp, Homo sapiens
  misc_feature (1)...(24841): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtgatagggccgccgcctcttcctgtgttgcaaaccacaggtccacccgctgtctactcctcacagaaccagcacagtgatagggccgccacctcttcctgtgttgcaaaccacaggtccacccgctgtctactcctcacagaaccagcacagtgatagggccgccgcctcttcctgtgttgcaaaccacaggtccacccgctgtctactcctcacagaaccagcacagtgatagggccgccgctggctaccacagggtgccatttccaccccggtgtccccttcgcccagtcttgggctgcaagggctgagaactacgcttccaggccctgtgggcaccaggatgccgctgtcatccagccagtgggctcgtcctgtctcggggccttggggtctgccgttcctggctggcgcaccccctctccaggctgggtcctgagtgtccttgtgttacagaggctcccaacctccttctccccaaggctgttcttctcctgaagcaagcctctgaccacagggtcagctgacccccagggttgggtctgggcttggcaggcagcaccctgggtcgctgtggcttgggttccattcccttgggctattgctcgagccccatgtcatggccctgagccccgctttcccgccaggctcaagaccatcagcctggtgatccgcggcacgcagggggccgaggaggtgctcagggcccacgaggagcagctcaaggaggcccaggccgtgccggccaccctcccggagctcgargccaccaaggcctctctgaaggtatcgtttcgaggcttgggcttcatggcggggtgggggtacagcgggcccagctgaagccgcacatgtccctcctgtccccaacagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagytgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcrgcaggagcaggtgggcttgggtcggtggggacggggcggctgggcgtgccctgcggccacggctctgaccacaccatcrcccaggccctgctggaggagatcgagcgccacggcgagaaggtcgaggagtgccagaggtttgcgaaacagtacatcaacgccatcaaggtgaggcccagccgcctgcaccaggccccaagtccgggaccgttgccrggatgatggcgggctttccctgagcctgggccatgccagggaaagcccatgtgagggtttaggggctgggcaggggccatcggagggcagagctggtggctgaccgcagtgcattgccacaggactatgaactccagctggtgacgtacaaggcgcagcttgagccggtggcctccccggccaagaagcccaaggtccagtcgggatcagagagtgtcatccaggaggtagggtggggccgaacctaactgggtgaggggctggcaggcctctggctggagctgcagctctcgcagggctaaccctggctctactccacagtacgtggacctgcgtacgcactacagcgagctgaccacactgacgagccagtacatcaagttcatcagcgagactctgcggcgcatggaggaggaggaggtacagcccgttgggcggaggctgggcagagggttccatctcaccacctgttgtgtcccacacacagccacaggagctgcctgaggccacctctcgtggccctccccactctccccactggcgctgccascaccccctgcccccagctcagcctgccccaggctgccccacctgtggcctgcccccctggcctggtgtggctacactgctcccccacagtggctggtgccgcctctcctccctcgtgagcgtcccccctgcagcctagcggccgtcctgtgggctcttccttggcgttctgcgttggcctttccgctcaaccctttgctgccagaagtcgggggtgctgagttgtggggctagggagggtcttccaaggcacccatctgttggcttctccctaccttctgcgtggccctgaatcctcttccgagttggctcgggtctgcactgctgtctccacgctggccgcctcgcctcaccccgccccacccaggcttcccaccctggtcggggagaggggtccagtggtgggagccaggcccactggtgtccagcagagctcaggcagggctgtgtgctgggtgtggctcgcaggttccgagctcctgctttgctctctctctccccgtccgtctgtctccgtcgcctgtctgcgggaagcagggaggacgcctgggcctccttccccaggctggtgagcacagtggggccggctgcgatcgctgcccgagcgccctgggcgggtgcacgctgtctcctccgccgggctggggcctctgtcttccccgacccctgctccgcgctgtctgagtgaactgtgccggtgcgtgccccgtcagcgcctgcccgtgttcacactctctctgcttctcttcttctctctgctgtggccrcagaggctggctgagcagcagcgggcagaggagcgcgagcggctggccgaggtggaggccgcgctggagaagcagcggcagctggccgaggcgcacgccyaggcaaaggcacaggcggagcgggaggcgaaggagctgcagcagcgcatkcaggaggaggtggtgcggcgggaggaggcggcggtggacgcscagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggcygagggggagctgcaggcactgcgtgcacgggcggaggaggckgaggcacaaaagcgayaggcrcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcrgagcggygcctgcgscaggccgaggtggagcgagcdcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggcygaggccgagcgggcgcgygaggaggcagagcggsagctggagcgctggcagctcaaggccaacgaggcgctacggctgcggctgcaggcggaggaggtgsygcagcagaagagcctggcgcaggccgaggctgagaagcagaaggaggaggcggagcgcgaggcgcggcggcrcggcaaggcggaggagcaggccgtccggyagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcrarggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagyaggccgcgcaacacaaggctgacatcgaggagcgcctggcccagctgcgcaaggcatcggacagcgagctggagcggyagaaggggctggtggaggacacgctgaggcagcggcggcaggtggaggargagatcctggcgctgaaggcgagcttcgagaaggcggccgctggcaaggcggagctggagctggagctgggacgcatccgcagcaacgcrgaggacacgctgcgcagcaaggagcaggccgagctggaggcygcgaggcagcggcagctggcrgcgkaggaggagcggcggcgccgtgaggctgaggagcgcgtgcagaagagcctggcggccgaggaggaggccgcacggcagcggaaggcggcgctggaggaagtcgagyggctkaaagccaasgtggaggaggcgcggcgcctgcgggagcgagcggagcaggagtcggcgcggcagctgcagctggcccaggaggccgcccagaagcggctgcaggcggaagagaaggcacacgccttcgyggtgcagcagaaggagcaggagctacagcagacgctgcagcaggagcagagcgtgctggaccrgctgcgcggcgaggcggaggcggcccggcgggcggctgaggaggcggaggaggcccgggtgcaggcggagcgtgaggcggcgcagkcccggcggcaggtggaagaggccgagcggctgaagcagtcggcagaggagcaggcacaggcccgggctcaggcacaggcggctgcagagaagctgcgcaaggaggccgagcaagaggcggcrcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatygaggctgagaaccgcrcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgygactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagcygagcccaggcccgcgctgaggaggacgcccagcgcttccggaagcaggcggaggagatcggtgagaagctgcaccgcacrgagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggtaccgccccctctacgtgcgacgggcgggtgggccyggggatctgctttggtgggtgatgggtgctcctgggytggcggtccctgatcacaccctcttcttctgcagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcmcagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagytggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctrcccaatggccgggatgcacttgatggccccgcggcagaggcagagccggagcacagcttcgatggcctgcggcggaaggtgycagctcagaggctgcaggaggccggcatcctgagtgcggaggagctgcagcggttggcgcagggycacaccacggtggacgagctcgcayggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaaygaggctgtgaaggagggtgtggtgggccccgagctgcaccacaagctgctgtcggccgagcgcgcygtcactggctacaaggacccctacactggccagcagatctctctcttccaagccatgcagaagggcctcatcgtccgggagcacggcatccgcctgctggaggcccagatsgccacgggcggcgtyatcgaccccgtgcacagccaccgcgtgcccgtggacgtggcctaccggcrcggctacttcgacgaggagatgaaccgcgtcctggcggaccccagcgacgacaccaagggcttctttgaccccaacacgcacgagaacctcacgtacctgcagctactggagcgctgygtggaggaccccgagacgggcctgtgccttctgccactcacggataaggctgccragggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggasctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacrtcatcgcgggtgtatggctggaggaggyggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggmaccaagggccgacgccaaggcctacagtgaccccagcacaggggagccggccacctacggcgagctccagcagcggtgccggcccgaccagctgaccgggytgagcctgctgccgctctcagaaaaggctgctcgggcccggcaggaggagytctactcagagctgcaggcccgtgagacctttgaaaagaccccggttgaggtccccgtgggtggcttcaarggcaggacggtgacggtgtgggarctcatcagctcwgagtacttcactgcggagcagcggcaggagctgttgcgtcagttccgcacgggcaaggtcaccgtggagaaggtcatcaagattctcattaccatcgtggaggaggtggagaccctkcggcaggagaggctgtccttcagcggcctccgtkcccctgtgccagccagcgagctcctggcttccrgggtyctcagcagagcccagtttgagcagctcaaggacggcaagacgacggtyaaggacctttcggagctgggctccgtgcggaygctgctgcaggscagtggctgcctcgccggcatctacctggaggacaccaaggagaaggtgtccatctacgaggccatgcgccggggcctgctgagagccacaacggctgcgctcctgctggaggcgcaggcggscactggcttcctggtggaccccgtgcggaaccagcgcctgtatgtycacgargccgtgaaggcgggcgtggtgggcccygagcttcacgagcagctgctgtctgccgagaaggccgtcaccggctacagagayccctactcgggcagcaccatctcyctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcytgcgccttctgccactgaaaggggcggagaaggytgaggtggtggagaccacrcaggtgtacactgaggaggagacaagaagggcatttgaagagacacagatygacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctaygactacgtgcgccgccgcctcacggstgaggacctgttcgaggctcggatcatctctctcgagacytacaayctkctccgggagggcaccargagcctccgtgaggctctcgaggcggagtccgcctggtgctacctctatggcacgggctccgtggctggtgtctacytgcccggttccaggcagacactgagcatctaccaggcyctcaagaaagggctgctgagtgccgaggtggcccgcctgctgctggaggcacaggcagycacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcagrgmggtgccgtcgtsaygacggcaccrgccagctgctcctgccrctgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaarggcatcatccgccccggcacrgcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggayggcgtrgtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagwcgctggagaaggtgtccatcaccgaggccatgcaccggaacctggtggataacatcacggggcagcggctgctggaggcgcaggcctgcaccgggggcatcatcgaccccagcaccggtgagcgcttscctgtcaccgacgccgtcaacaagggcctggtggacaagatcatggtggaccgcatcaacctggcccagaaggccttytgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccwagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgcyggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgygcccacccygctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctytctcccatggagccccagccccctttgggcccagggacaccagccaggctctgtgctgaccctcctgttgcacccagccctggtctcagcagcgaccacccctgcctccaccctcygagctttgcatgttccactaaccccgggcgggtggcaggtggaggtgtcaggctgctggcgcctctgcaagggcagaacactaacctgaccgtgggcggggccttgcggtatccgcccccaataaaagcaattccaaccttcccgtgcctccggccttgtgtcttggggtcaggtgtgtgtcagggacagggtggacattgcagccccaggctccaggctctgagctcagccactatggccagtcagggacgtacgtctgtgtgcagcagagaccaggtgctcgcaggagggcagctgagagaccctgggcagagggattcagtgtggggcagggtggtggccacactgaggccgggccccctgggacctgctgctggtcaggtgctgaccagtctcccagccccacccttcgcactataaggggctcacgtttccttatctgaggcggggtgtggtatgctcccatatcagtcactggctgtggccccttggcctccggggagggtgccacatggccccgggtcagttggttgctgctggccgggcagccctccagagaaggggccacaggcagtgggcctagtatgagggcctccaccacagtctgccatgtctcggccccatgcccatcacactccggggattccatctggatgggcttctccaggcttccgactggtggcagtttctgggaagacttaggggaggagggaagcggggccaccccagcctgcagtagccactggtccaggctcagccgatactcttttttttttttttttttttttcaggcagagtcttgctttgtcacccaggctggagtgcagtgtcatgatctcggctcactgcagtctccacctcccatgttcaaatgattctactgcctcagcctcccgagtagctgggactacaggtgtgcacccagctaattttcatatttttagtagagatggggtttcaccgtgttggccaggccggtctcgaactcctggcctcaagtgatcctccctgccttggcctcccaaagttctgggattacaggcgtgagccactgtgcctggccttcgcctctcctgctggtgggacccaggcgttcaccctggggtccaagtcctagtcttctcgctcttgctgggctttaccctccctgccccggcccggtagagggtgctctgcctgctggtccgctggaacaggagtggccccggccgggtgacccacagccatcgagcggggcagtgccttactctgtcccaggtggctgggttttaggacctctgagccctcacagcttaagagttgcagggaaaggaagcacaggttgtcagtgggtcactgggagctggtgagtgggcggccactcctgcctctaccccttggtccccagacccatgcggtcctctgtggggccactgatttaggccgaagaccacatcctggaggacgggaccaccacagtcccagagggttggtgtcaggacggtggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgccacttcccgcttgccaggcctggtgggtgcgatgctgtcagtgagcggacttgcgtgtttgcgctttggtcagttgtctgtgtgtctgcatgtctgtgcgctgctgtccacctcgtgtgaatgggaactgcccctgacctcctcccggtgcagtggagagccctctgcccagccaggagccacaggacaccgtctgaggctgtgagtctgctccaggaaagaccacagacagcacagcagctggagttggcactgtggggggacgctgtggctcagccgccgtccaccacagtctacccagctcttgtagggacctgaccagcaaattaagtgggaagatggtggccatcacccatgcaccctttaggcatctgcggtgttgctgacgccgccgttttgaccaggaggttgtattgttttatttccttggctggagctgggggtagtttctaaggtttccatttggtctttcctactacagtgatttttactccatgggccaaaaagcccatgtgaggatttgctgttgagcatgccagttccaattgcacgttcctgggctgggaaatgatgggctgaggcctgggccaggactccaggtccttcctgaccccatattccctacccagatgggagcctctgagggtgctttgcgccccaggtgtcagcgtccactcagaccctgatctgggcgtcttcctctccccagggcacagttgtccagataagcatctttgggtccctggagggactggggggtcactgctgtccacacttggaggcgtgaggcctttcacaaggggacctggccgctctttccatttgtgggctctggctctgagaactggctgacataaggaaacaaagcaagtggttgtgttttccatcagagcagtgggcctggactcactcactcgttttaaaatttgtgggtgccgcgtgctgagccagtgtcctccgagtgtgccccgggaccacctgggagcttggaaggggcagagccttggccgcggcacagaccaactgagtcagaaatcctgggcctggggctcagccagctgtgctttaaggagccctccaggggctgccatgtgcctgagtgtgagaaccagtgtagtgagcagctccttgcaggctgcccatctgcgtctcctgtcagactgtggcgctccatgagccagcttcatgggcccccatggtcagggtcttctggccgctgcccccaccttccctcccgctgccagcacgtctcaacaggtgggagctccagcggctgcactgccattggtgccaggctgacagcatcgccaggcagtcggtggtgttctgaccaactgtggcatctgtgcgccaggaccacgtctgcgcccccccatcccaggcaggctccccagggcggtgcctcagttacacatggtttctggagaattctcagaaaaggggtgcaacaagtggggagggcaaggagctggcaaagggggctggagccgtagccctgccccacggacatctgagaggcaagggcacagctcagaggctctgactcctgcccacacgtgggtctgagctgcctgtggggtggcacgtggtcctcaggcatctctgaatgagcagctcttgtcagccaagggcagtgttctggaggaggacacaggtgagcgtctgcagcagctggggaggggaacaaggacacccaaggggatcttggaggatcggccacggcagctgccttcacggtggcagctcctcagtagcagcgcagacggaccgagagacccttgaaaactcctcccacgtaaatccgggtaaaacttaaatagcttctcgggtgcattctgacgttaccaaaaagacaaggaaaccaccaggggtgaaagagaaaggagggtcctcagtgcagcggctgagctgacgcttcccgaggaatttgctgatcctggaaggctgaagcctcgggttttaaaggtcctcaggaacaggaggccgggatgcgggccgtacagccagaggcctctgtggcatccggatcctcaaagggctgcacccagcgagaaagcgggttctccgacgatccagccacagaagggaaacactggatcctgcctgggctctgacaggaaagcgtttccactgagctttacaatttcaggccatccccctgtagggtctggagaaccccatgtggaggaattacatcaccatggccccaggttggttgttgcctggtacctggtatgagccaatataatcttatctggaggtcttgcccccaaccaaggcttcccaggcttcagataaaagacctcgggctttccaacatgacgcagtcaaaagttacaagacgcatggaaacgagcatcatgaacaagggcagaactggaagctgagggacgcaggatactggaattattcaataaagaatacacagtgagtatgtttgaaatgtttataacacaacaaatccataatgtgagaagtaaaattctagctaaaaagagcaagaagattttaaagaaatttgatagaatttctagaaatgaaacatatactaataatatttaaagctcaatggactaaacagcagacgaatcatagttgaagaattggtgaattaaaggatagatctaaagaaattactcagaatttatccccagagatgggaaacaggaaagagaggttaggaggcagaacagaagacatctagcatcagtccagctggggttctataagaagatcctggaataaggtgaggacgttttgaagaaatagtggctgataattgttttccaaatagatgaaaaacatgaaccatttatccaacaggcacagtaaaacccaggtatggcaaataaaacatctacatcaaaacacattgtagtaaaattgcggaaaaccgaaaaccaaaaaagaaaaaaaaattaaagcagctagagagaaaagacagattccctacgaaaggataatggacacaacccattagcaaaagcggaagcctcttaatgtgtgttccgtgaactaggagcgagcgcttcacccttgaacttttgaaatgaagactctcgagacccagcgcagacccactgtggagacagaagtgactccgtgttaggttctactccaccgtgcagacttctgatgagccgccgtcctgggaatgccccgattcctgccgtatctactgtccttagtgtaagaacgtgcactcgctatgaatcctgcctttccatcagagcagccttgatgttattacacagatgacaggcgatgttgcgttcttgcctgtgtggagcatgcagagcctttccctacagagaagctgagccctgggtctggggagcaacagtgcagagctgcacctgtcccacccaaggccacccctggtggcaggttccccagtagagcaccctctcctgacaaaccgaatctgtcagcctc

SEQ ID NO: 10754 - DNA, 49385 bp, Homo sapiens
atcagacactgtccctgacatttagaaggtaagagaagcatgtaaattgccacgaaataagggaacaagagaccaaggtcacacagcggtgcctctggggcctggggttgggggagcatctctgcctccccactcctctgtaagggcttctcagagactgtggaaatacaaataaaggacaactattccatttatttatgtatggagacggggtctcactacattgcccaggctggtctcaaactcctgggctcaagagatcttcctgccttagcctctggagtagctgaggctacaggtgtgtgccaccacacccaacgaattttttatttttattttttgtagagacagggtcttgctatgttgcccaggctggtctcaaactcctgggctcaagcaatcctcctgcctcagcctcacaaagtgctgggattagaggtgagagccactcacctgtacttggggccgtgggagaggccacaagtctggagagatcaggggtctggaagcagccaccccctcttgccacatggcctgtggagcacatggcttgggacagtggttcctttagaagccggagggaccacgaatccttttctgatgataaaagaagcacatggggttgggtgtggtggctcacgcctgtaaccccagcactttgggaggccgaagcaggagggtcacctggggtcaggagttcaagaccaccctggccaacatggtgaaaccccgtctctactaaaaatacaaaaattacaatttgggaagccgaggagggtggatcacggggtcaggagatcgagaccatcctggctaacacggtgaaaccctgtctctactaaaaatacaaaaaattagccaagcgtggcagtgggcgcctgtagtcccagctactcaggaggttgaggcaggagtatggcatgaacccaggagttggaggttgcagtgagccgagatcccgccactgcactccagcctgggcgacagagcgagactcggtctcaaaaaaaaaaaacaaacaaacaaaccgaaaccaaaaacaaaaattagccaggtgtgttggcggacccctgtaatcccagctacttgggaggctgagtcaggagaattgcttgaacccaggaggcagaggctgcagtgagccgagattgccccactgcactctggcctgggcgacagagtgaaagtctgtctcaacaacaacaaaaacaacaacacaaaaaattagctgggcgtggtggcacatgcctataatcctagctacttggaaggctgaggtgggaggatcacttgaacctggaaggcagaggtgccactccacctccctgtgagccaagatcactccagccacccaggctgcaacagagtgagccgagatcgtgccactgcactttagcctgggtgacagagcaaggcttcacctcaaaaaaaaaaaaaaaaaaaaaaaagtacatgctattttgtgtaaggaatccctccagctccagctgtacccccatgtctgctccatcatcctcgcatcgttctttactctctgggagtttattattgagctgtgttacttttgtctgctttcctattttactgagagccccaggagagcagcgcggggccatcttatccttcacttgaacctcgctatatccctaccatctagtacattgtaggtgctcaatacacgtttattcaacaaaagatcttatatattcatacacagaatattctatggcctcagactcatactgtgtatatggttgtatataccttttcctcaccatttatgcttttttagtattttcttgtcattaaatcttccttgagaacatttttgaaagagccatgcagtattcatttacactgatgcctgtgctttacttccccccaccaccatctcttataatctttattaacctattgggaggacttttacttatttatttatttgtttttgagaaagtctcgctctgtcacccaggctggagtgcattggtgcaatctcggctcactgaaacctatgtctccaaggttcaagtaattcttgtgccttagccttccaagtagctgggattacaggcacatgccaccacgcctggctaatttttatatttttagtagagacggggtttcgccatgttgcccaggctagtctctgactcctgagctcaagtgatctgtccctctcggcctcccaaaatgctgggattacaggtgtgagccaccatgcccagccttatttacttatttaattaaaaagaattctataatagagatgaggcctcactatgctgcccaggctgatctcaaactcctgagctcaagtgatcctcctgcctcggcctcccaaaatgctaggtttacaggtgtgagccaccacacccagcctatttatttatttttaagatacggtgtcttgctatgttgcccaggctggagtgcagtgatgctatcatagcttactgcagccttgaactcctgggctcaagccatcctcctgcctcagcctcctgagtagctgggactacaggtgcaagccatcatacctggttaattttaaaattttctgtagcaacgaggtcttgctatgttgctcaggctggtctcaaactccttgcctcagcgatcctcccaccttggcctcccaaagtgttgggattacaggggtaagccaccatgtctggccctgtaaaggccttcttgagggaaatgactgatcgagcaaaggcagtgtgtgttgggggagcagattgggaggatacgagaaaagtcttaagggtgttgaattcaggaacggtgtctagagagctatgtgactggggattcctgtgcccagtagtgtattggtaaactgactctcaaaaacaaatgtagcatttgccagtttccatactgtaaatcctaccctagtcaatttcaagttcccatgtgatgtggctaaacatggagttggaaagttatgtgcacagtcgaatccagtgccgatgggagcgggctccaggacgcccccaccatgcccaggcccgattcctcttctgggatgaggagccctctctcctccatgcctgtgagccctccctgggccacaggcccagcatctcagatcaagtggagactcagccagtcctggtcagagggctcagcatctcagatcaagcaaagactcagcctgtcctggacagagggcccacaggggaggccggagccctgatcttggaagctgtctatcagatttctcagccaggatgaaaatcctcagattcccccagctcagcgatctggaactgccctggctactgaagtgtgggccttcatccatgtctggaatctggggctgggcctgcattctacctgggcaatgtccccaggacccagcctcagagctaagccaccaaatggggctcagtatcaggcacaggacgtcccacaatggccatgacatttattgagtgcttgtagtatgccaggctgtgctaaacacctggcacttatttcttttccagcctcatgctcatcctagaggtggattctattagtatccccactttacagatgaagaaactgaggcactgagagagtaactcacttgcccaagaacacttggcttggaagtacaggtgccagggttcaatcctaggtcagcctgatgctaaaccctcttctggtaaaccctgagctcagcatttcttcccacttaagtctttatgaaacacctgctgtgtgtatcgcatgggtattgcaagagatggttatgaatttacctttaaggagcttggggttggggtttggccatttcttgagcacctactatgtgccaggaatgatgctaagtgccttacgctgccctcgagattaactctcataataaccctgggagaatcaccagcctgccctctccctgcctagctggatggtcccgcgcaggtcacacactctctctggtctgccttttccgcttcggtcccttggcatggactgccctaggcaacctccaactccctgctagtttcaggtcagagattctcagaacaacaggaaatggccgggccatgtgcaaagtttggggactgtggccattgccccaggcaaattttggggtcaccctccagatattggacaggtaacagcgctggcttgctggaggcccagctggcacagtctatatccttggtatttccccgtggggagctggggaagggtgtttgggtatatgacttcctgcttagctctggaagatgggccaagatggctgcgtggcagtttggctggcatcccatgggggctggaggaacaggccccttaggttccatcatcagggggttccaaaaggggtcctgggggtctggaggcctgtctgcggtctttgcaggctcacagaagaaaaaggctcaaacagtagcttccactaaatgtgtgtggtggggggcggtgtggggcggggggcaggattcccgtcttaaagcttcagttacatagcaaataccttaagtaccattccccccaccaccttaggtggtatattttctttggagagaatctggggtaactgataaagatcacagtgggccaggcatggtggctcacgcctataatcccagcactttgggaggctgaggtgggtggattgcttgagatcaggagttcaagaccagcctggccaacatggtgatataaaaatacaaactataaaaatctactaaaaatacaaaaattaaccgggcatagtagtgggtgcctgtagtcccagctactcaggaggctgaagcaggagaatcacttgaacccaggagtggaagttgcagtgagccaagatcgagccctgccctccagctgggcaaaaaaaaaaaaaaaaatcacagtgggatgactcctttggggctattactgttctggatctaaccctggattacccctcatgccccgctgaggatgttgcaatacttctaagccttggagcctgttctgctaggtccatttcccagatgggattaactgagaccccatctctggtgggtcagagactcaccaggcagccaccagctggggaaggaattccagggctctgagttcctcatcagcctgtctgggttgctgggtggggagtcaagaagggagactgggaagcagaccattgggctgctgacggatccaggaagggcactcctggtctcaccggtctgggcgttggctcccgcactcagtctgcaggggcactcccattggtgcctggcctttctaagaggtcttgggcaggtcaacaatgaattcacagggagaaataagtgtgcgaacggatctgttctgggacaggccctgcctgtcatattatctcatttaaaatcagaaaaatgtacaaacctggagccactggagcagagagaaaggaaagaaaatctctaccggagtggaagggcatcctggaagccttcccaggagaggtgacgcgtggcccacgcctcaaaggacaacaatcagaatatcaaacactttctggacgtgtattaggtacttgtcactgtcctgagacttttatcttcattaactcttttaattctttcaaaatcctgtgactgaaatgcaatgtcatcctcactcaacagatgagaaaaccaaaccaaagcacagagaggttgaatggcttacccaagtccagacagctaccaaatggcagagccaggattcgaacccctggaaggcaaatcagttactgactgtgagacctctgccaagttatttaatccctctgaacctcagtttctttatccataaactgcggrtaatggggtaacagtggagtagtgtgtagtgcacatctggagacaaaaatgagctaatcccagtaaagcgcttagaacagtgcctggcacccatgaagtgttcaaacaactgtagatgactttttatcatcgctgtagtggttatcttcaagccttcccctcccccatctggccgcggcttcctcccccgcagtgccagcccgtgacgttagagcagagtctgggttctgtgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatggtaggcaaggaggggtgggggcggagaggtgtgaatatgttggatgagggacaggcgggggcacagaccatgtcttttaagcccaatgccaactcaccaggagccagcggccacgcccatcaggacgggggcccctccccacctggcggtgcacccttgtctccgccgcccgtgcgctctggcgcgcatgactggggtgccggtagagggcgcgcgagggggcccggggtcaggtgggggaccccattggaggcgggattgtggggaggtccctgggccgcccctcccgccccctgcccgcccagcctgcttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtgagtactcctcgggcgcttctgggtgaggggcgcgcaaggcctggggtggggccgacgtcgccctttccgcgtgccagggcgggttggcaggagggcgaggggttcttgtccaagactggtcttggggcagttccgctttaaaggggcgagaggccgcatgcccatggctgtcccggtgggaggggggcgcctagagttagcagatgccccgcctcacccccgggcaggggagggggtgtctttgttcccgggatgtactaaagggggtcgtccagagctgaagaggggattagagggccatattctgtcagatctgggaggggagaaagcggggggtctcttccttagtccaggcagatgttggaggtggctcctccaggcgtgggtgggggcctagcaagggaaccctggggaggacccttggagagggcctgggatcagatgagccctaacatcctgtgtggatctggtgcttaggtttgcagagtgtcaccaggtggccctccagggtccttttgaccccaagccctgagctccccagtcttgtggctcccagcctcgtgtgggccttccccgggtgctgagctgcttgaagagccaattccttgctgcgaccccctccccagccaggtgcaatgggactgggggaccctacggctcccttcactactagtcccaagctatgcttcccccagggctgagtcagcagctgctgaatcagcagaatatggggggcgggttccccctcctgcttggcatagtgcccagaaggggctctgagggccttagcacctgcgacaggtgtgggatcctctggaggacatttgttgtgtgaccttgaacctgcttctctctgggccttggtttcccatttgggcaatgagagctctggaccggagtccccatctggttgcctggggtctcccatccagctgggagggtggaggacctgttaggagttcccctgtggcccaggtgagcaggagcatggattgggagccttcacctgtgtcaagattcagtcttagctctgygctgattccccaaggtgtgggctcccagagaggactttcctgcctgattttatgacattcccaacccccaaaacactgcagctgcgtcaagggggcagctgttgagagcaatttttgccacccttcatcctcattggctactccaaatatacacaccctgaatgagaagcagagtgtgtgctctgacagttcagtggctggacaagcccccccaccagactctttctaagatgtcccctcagaggccctgggaatgagacggcctacactgttagggcattgaggccaggctggatgcctggcagctgctaggtggtgaaaggagttctttccagaaacggggttctcactcactgagctctggcccctccaccagccctgggtgagaggtcatgagggggcgatgggtgtcacccctgcacctggacactggcttacggtaacctgctgctcttctggagaagggacttgagtcatgcctggttcctgcagctcttggccaaacttcctgcccccaattcctgggccagtgagctatgaaataggtcatgccctagagcaagggtggggaggagtcacttagccccagctggcagggggggttctggccaccctgcctcagtttccctagctgtcagcacccttcttcaaaggggctcttcctggaggctgctgggagctccatgccatgggagcccttaggtggggtgtgttctttccctcttctcctaagggaaagggcccagattctgcctaaagcattgccaggtttgaggggggtccattctggcccgggaggaggcctcttcaggtaattttagagtttttactattagaaatagtagcagtcagtcactgagggcttagtatggacaggccctgtgcttaacacttcatatagttctattggcgtctcttattttacaaatggggaaactgaggaccagagaggcagtcacttgcctaaggtcacccagctgcgatttgaactctgactactccatgcccaaaccagactgggcaggcaatggctgaggggcctgctttcccaagactgagctgagtcaggggccgtgggagaggccacaagtctggagagatcaggggtctggaagcagccaccccctcttgccaccgttgccctccctgataggagtctgataaggccctcatgcgtcagagccctgcagctgactagtgctgagctcggctcccaggagggcctggaggtcaggctgggtctgcaggagggggtgtgtctcccagccctcggctagtgggatcccagcccatctgaccccacatctgtagttggggaaactgaggggtgggagcctgcataaaggaagcttaggggtggagaacccagggaaggaaactgagacacaggacattaccagccacaggagtctgaaggtgaagcccagatggggaaactgaggctccaatggatttgggatggagccagaagaggaaactgaggcttggggcactccacagaaggggattcagatgtaggatccacagaggatcacgaagacactgtctgtctaaagtgttcagggatagaagccaggtagggaaatggaggcattggagtgtccagccagagggggatgagggaaggagtccagagagggaaaccgaggcacagggaagggctcatccagcaagataggttcaggttggaggcaactcttagcgccaatgtccctctttcctggcatcccagaggcatttgtggatctatacaaactggagagacagaaggtggcagagatcaagggagtggtgctggggcatcgagggagagggccatttgaataggtagagggggcattggtttcagaacatgagtgtgagcccacaaacctgggtcccagtcctatctccactgttactccgtgctccagagagagcactccataaacccagtcattcagaaatagctctagagggccaaatgcatgccagatgtgggggccaggggtggggaagtgggggacacagactctccccagggagttcacagtttggaagtggcagggaggtggggagacaatactaaacgcatagagaaataagggaggccggctgtggtggctcacgcctgtaatcccarcactttgggaggccgaggcgggtggattactggaggccaggagttggagtccagcctggccagcatggtgaaaccctgtctctactaaaaatgcaaaaaattagccaggtgtggtggtgtgtgcctgtaatcccagctactcaggaggctgaggcaggagaatcgcttgaacttgggaggcagagattgcagtgaaccaagatcgcgccactgcactccagcctgggtgatacggtgagactctgtctcaaaaaaaaaaaaaaaaaaaaagaagaagaagaagaagaaagaagatgattttaggtggaggtcattttagataggacagtggtggccagggacagcctctcaaggaggtgactttggactgagacttgaatggcaggaaggagccagccatggcagtatcagggctaaagtgtcttaggcaaagggaacagcaggtgcaaaggccctgaggctggcctggggcctgatgaaagacaaagaagccctgtatgatgggatggaggaggaagtgagggacctgttagacagcttgggatttgctggtgactgttattatgaaggggggatgcagctggcctgaattggcagatgactcatagctacttaagggggtgcagcacatcttaagagatttcgagggttgattttgaagcctgggttccctggtctttgcctgtagggagggtctgctgagtctgtccccatggagggctgaggaatggggagtccccttcccagggaagctcccattgaaatgaaaagctggggacacagcattaaagcccctgcaggggagagctgggggccagaccatgatccggcccagcatttgagttcctccagccccctargaggtgtatgtgagcatcacacctgatttatagagcagagaaactgaggcccagagagggaaggggactctctgggatggcacagccagagggtggtgaagccaggcattcaagacccccccaccccccccmcacacgctctgggcctctgctttgggcttttcgaggccaggactcagaacctgctggcctcaggcctccctgttctatttctatgggtggaagcccagagtgcacagatgtggtggcctgggcagctgtgacatctcctgctggtcccctaaggttctacttctgagctggacttgctgtgtgaccctgggcaagtccccttctctgtctgtgcctccgactcccctgcctgtgtcatgactgggaccctccacycatggctgccctctcaacctgcttcctccctgaactccctccttctgcaggtctgggagcagcgacccctactgcctagtgaaagtggacgacgaggtggtggccaggtgaggggtggcgacacgggggagaggaggaagggaggggtctctttctagacctggggaatctgggaccaagaattcacatttaaaggagtgcttaccctgagggggactcgcgggcctgcaggtgggtgatttgtgtccagctgggactgccagctyctctccccgaccagccctgccttccccctctggacctaatgctgtccctgctggctccctggggctgactcagcgctgccagcctgtgcctcctacagtggcctccctgggggcgggcatctcacgcttggctggactggttggttccgggcctgccgggtgctgcgggcactggggatgtctgtgcgcgtgggcaygtgcatgtgtgtctstgtgtgcacccgcccagctgggcctgcttgtgagttgcagggggtgggggatgttgcggggctagtgtgagtgcctgtgaccacgtgtgtatgtcctcgtggctgtgcagggcacaggctcacgtgtgtgtaccagtgtagggtgcatgtacatgcacgtgcacatggctgccctgcacatgcatgtgaacaccaatgccagctgatttggtcacaaaggcaccggtgtggacacatgtgaaggtgtgaggatgtttggggtgtcagtgagtctcgcagggggatatcaggctgcgccctgcttggctcccacccccgcaggccgagggacagctctcagcccctggaggcctgatgggggtgggtgggctggtgggtggctgaggccttggttcctatggagacggcaggattcaggatgctcctattctggtccagatgggctcagagctgggggtggggagcctgcctgggggaggggtcagctgtagctcccccctccactgactcccctccactgtcctcccagtgctcatgctggccccttgatacattccctgacaccaccccaaacccacagattgattttctgtgtgaccccaggctgctgtctctccctctctgggctgtaagaagcctttcagctcaggagctggggaatgttcagaagacctttggctgggaaaaggtcaggttgggggaagagggtatttgggaggaagcactgggggtccatctgaggttggtgccgctgggctggaggaagaaggcggggtgtgtgtgtgtgtgtgcgcgcacgcgcgcatatgtgcactctttcttagggcacagtgtggtgaaaggagggaggaagggagcaacaggtatgagaaccaaactttgcatccacaaatgtgggtgtgtctttaccgggcaagtagaatctgttctctgctgggtaaagggaagtacccctgcagggatgtcagggcagagatgctgtgtgtgtgcacctgtttctgggcttatcttggtccccatccttcctgtgccttcctcctgctcactgtgtgcttcaaagccccgagtgctctgtcccctgctcacctcctgtctcctggcccctctccctcccccattcccaccaggcaccttcctattccttcagctcacgaaactcattcctgctacagggcctttgcccatgctgttccagccttctggaatacttgtccttgtcctcattgtctctccccactttgcctgactagctcctacaggaagccttccctaatcccctccgaccctacccccacgacccaaccaggggcgattgagctaaccccaatcccaggacttctcccaccatgtcctaattgctgggagagagcgcctgcttgtggaagggggktctgtggggtaagcagccctgacacctgttcctctgatccctggagcccagcacaggctgggcccatagtccaagtgaatgtttatggagtaaacgaatgaacaaatgaatgaatggaattgtgtgtgtgtgtgtgtgtgtgtgtgtgtgkcagtgactgtgtgtttgtatgactgtgtgtgtgtctctatgtgtacctgccttgtatcattgtaagtgtgtgagagtgtgtctctggatctctgagtgtgtctctgtgttcccgacatatgtctattttcatatgttttcatatgtgtctgttttctatgtgtctatctgcatgtgtctggtgtctggatttccaaacacaaaggtacatgtttttaggactttctgagggtgcatatgtgtatctgcttatgtgtaaatgtgtctctgtctctggcctccttggtgtatctgtgagcaactctgtctcagtgtgaatccgtgtgtgtgtatctgcacatatgtttctgttggttgctatgcatgtctgttggtctctgtgtatctgggaccttagatgtgtattggggccctgtatgtgggtgtgtaggatcatgtgtgtgttttgtgtatgtgcctctctgtgtgtgtgtgtgtgtgtgtgtttgagatctctggtgtatgtctgatactctgggtatgtgagtgttggggtctgtgtgtgtttctatgcctggattcatacatgctccagtgtccctgggtgagtacatatctaggatcttggagtggctgtccttgggtgtgtgtgtgtgtctgggcctctaactgggttcatgtggggggtctctgagtgtgtgtgtgtctggattcccgtgtgtgtgtgtgtgtgtgtgtgtgtgtgtgtgtgtctgggtctccaggtgtctgcctcctgtgtggcccgaggaccccagccccctgcacctccttttgcaggacagctactgtctggaggagcctgggccccttctggggggaggagtacayrgtgcacctgcctctggatttccaccagctggccttctacgtgytggatgaggacactgtcgggtttgtggttggggaaagtggaatgtgtgggttagggacccaagcctgggcacctgaggggagagggratgtgggtccacagcccacgagggtgtgccctcccacccagaccttgacacctgcccccacttctcttggggcggggcaaaggggcccctgactcagaccttcacgtgcccgccttcctgcaggcacgacgacatcatcggcaagatctcgctgagcagggaggcgattacagccgacccccgaggtgggcgagggacatgggcagagggaggagggggccatgcccagggtgggcatttgcaggggcatagcacatggcacggtgaagcacagagccttcagtggaaacttatttctcttgttgcttttgtctttactttttgtttgcttttaattgttgttgttagagatgaggtcttgctctgtcacccaggctggagtgcggtggtgctatcatagctcactgcaatcttgaacctctgggctcaagcgatcctcccatctcagcttctsgagtagctgggattacaggtgcacaccaccacacccagctaattttttcagaaatatcttatagatacggagtcttgctatgttgcccaagctggtctcaaactcctgggctcaagcaatcctcccaccttggcctcccaaagtgttgggagtacaagtgtgagccactatgcccagccttgtctttagtttttgagcagttaatttgtttgcctagttcaacattcagattttatgataagcaccccagctactctgttcccttcctggcattgtcagcttcttgtatgtccttctagaaatattttaaacatatataagcaagtaacagtagtaatagcaggctgggcattgtgcctcacacctgtaatcccagcaccttgggaggcagaggcagaggcagaggcaggaggatcgcttgagcccaggagtccgtgagcagcctggacaacatagggagaccccattgctactaaaaataatttaaaaataataacagcagcaaacatttatatactgtatatataaatataaacatataacatatttatatataataaatataaacatataacatatttatatataataattmtatmtaaatattattctgaacactaattctttatatttatggactcagtgatgtaggttcatcataaccctgagaggcaggtgctctaattattaatgcccactttataggtgaataaactgaggcacagaargttaaatgacttgctcaagatcacattattaagtgaggcagccaggatttgaaccaaagttgtctagttccagagtctatgccttttgtgtgtgtgtgtgtgtgtgtgtgtgtgtgtgwgtgtgtgagagagagagacagtgtctcattctgtcacccaggctgtcgtgaagtggtgcagtcttggctcactgcagtctcaacctccctggctcaagtgattctcccacctcaacctcccaagtagctgggactacaggcgtgcaccaccacacctggctaatttttgtatttcttgtagaggaagggtttcaccatgtgaaatcacgctggtcttgaactcttggcctcaagtgatccacctgccttggcctcccaaagtgctgggataacgggtgtgagccactgcaccaagccgagtctgcgctcttaatactgtgtttttctgtgcttatacaaattgcagccttttacactctgctctgtatcttgcctttaaaatttttttaattaattaatttatttatttttgagacggagtcttgctctgtcgcccaggctggagtgcaatggcacaatctcaactcactgcaacctttgcctcccgggctcaagcaattctcctgccttggcctcctgagtaactgggattacaggggtctgccaccacacccggctaagttttgtatttttagtagagatggggtttcaccatgttggccgggctggtctcgaactcttgacttcgagtgatccatctgccttagcctcccaaagtgctgggattacaggcataagccactgcacccggcctgtaccttgccttttcacttcactaagtatctctgagatcttcctataacagtggtctcagagtttccgcattcttcgtttgggatggcatcgtggtgcttcattgtgtggctttaccattgtttatttggctagttccctactgatggcatctagggaggtcatagtctttccctggttcaagcaatgctacaataactagcctgtacaaataaaatttcacacatatgtaagttatatmcatcggtcagataaattactagaggtgaattaaagagtgcacacatttgcatacttgatagttgttgctaaattaccctccatggaagaggtagcagttcactcaccccacactctctcagttatcaaactttttgtgatcaattagttgtaaacaccaccgcactcagaccagccagttatcaaactttttgatcgtgtatctgataggtgaaatattgcctcagcataggtttattttgcacttctccatgagccttttttatatacagttttgaagaatcactttattttctcttccatttattgtctactcatattatacatgaatttccccccactaggttgtttgccttttcttattgatttgtaggagctctttacatatttgggcagttacttctttgtcaaattagctgcaatattttttctccatttgtctcttaygttttgactttgcctrtaattttttcatgtataaaatttctttttctatatttaatctcatatttttcttttggttctgaattttctgttagacctaaaaagaacttctcaactctaagattaagagaaacattttaaaacataattccttctaacattaatgtattacatacacaaacacacacacatatatgtatatgtattttttttttttttttaagagacaagttctcactatgttgtccaggctgatcttgaactcctggcctcaagcaatcctcctgccttggccccacaaggtgccgggattacaggtgtgagccaccatgcctggccatttattgcattaaacaaaaaacacatttaagtctttgatctatttggaatttgcctagatacaaggtatgtagtaaggattaaactttattactttttgtctacatgactgttaattgtctcaataccatttattgaataatgcattatttccctcagtgggaattagttgaaaacctactatgtgctgatcatcattataatcctatttcatgagggcctactatatgccaggcatggtgctaagcgctttacttctcaacacaccagtgaagtgtccaccagaatgatctccaatatacagaggcayagagaggggaggtgacttcccccttctagaaggttcagaaatcagagtccaacccaagttttgtcggcctccaaaatctgtgctcttaatctgcccactgagctgtacccagtgtacctcaaacatcctcccagggcagtgaaattaaatgagtgaagtttgaggcctggcttgcaggaacttgtggacttggataggaaaacagaacacattcccacagaacaggcagcaagaaaagaaggaacgtgtccatgtgtctgcaagcatgtggcggaaatgtggaggctgcagtggagatagagagatgtgagatgagacttctactttcagcagctggcgggactcaatcctcaaaagcactctcctgctatacaacagtgagatcctggattaaatagggttcctaatacattgttggacttgtggtaactttttttttttttttttttttgagacagagtctcgctctatcacccaggctggagtgtagtggcatgatctcagatcactgcaacctccgccttccagtttcaagcgattctcatgcctcagcctctggagtagctgggattgcaggcrtgcaccaccatgcctaactttttttgtattttcatagagacagggttttgccatgttggccaggctggtctcaaactcctgacctcaggtgatcagctcaccttggcttcccaaacttttgggattacaggtgtgaaccaccatgccaggccaaacttctttatagaacgggaaatccctcagtattttttccatctcaagtcatgagactgggtggaatagctcacgtgtgtaatcccagaactttgggaggccgaggctggcggatcagttgaggtcaggagttcgagaccagcctggccaacatggtgaaaacccactctactgaaaatacaaaaattagatgggcatggtggcaggtgcctgtaatccttgctattcgagagactgagacatgagaattgcttgaacctgggaggtggagtttgcagtgagccaagattgcaccattgcactccagcctgggtgacagagtgagactccatctcaaacaaaaacaaaaaccattagctaaaacctaacagtgaatggtaaacaaaagcaaggagaccatgaaggatttccctgaaagcagacgtcagtatcaattctacactcaacaaagagactaaaacttggacaaggggcagggtggatgttactcaacatgagaattctccattaggctgagaccctcaaggggtcccagaataaccaactcctgctcctctctagggataagcatgttcacttaggtttcccagagtaagatcaaacaaacatgacttcacaatcaaagatcagcaaacacacaaggaaatgagacaccawgggcaatagtcagcagaaacaataatcatctgatttagacccacaaagactttagattctgtaattataatatacgggatttttaaaaagaatcagatttaaagaaataaaagatgtaatcacaagaaaggtctgcaataacagcaataaattacaagtaattacgcagacagattttaaaaaagcaccaaataaaacttttagaggtaagtataattgtcaaaataaaaaatggagtggttgagtgaaacatcagattattcatagttaaagggagatttagtgaactggaagaaaggtctagagaaattattcagaattagtttcagaggaaaaggagaaaaaataaaatagaaattcagagacatggaaaataactgtggaggtttaacatttatttaattggagttccagaaggatagaattttaaaaattagagacaggcaaaaattataacaaaaattgggaagaggaaataattttaaaaaatcaatcatctagaattttgcagaaataaaggaaggatatgattccataaatagaagcagtgcaatctctactcagcaggatttwaaaaaatctgtatctagacacattgtgatgaaactgcagtgcatcagagacatagtccttagaattataatagatagaaaagcctgggcatagtggctcctgcctgtaatcccagaactttgggaggccaaggcaggcagatggcttgagttcaggagttcragaccagcctgggcaacatggcaaaacctcgtctctacaaaaaacacaaaaaattagctagctgtggtggtatacatctgtagtccaagttactggggaggctgaggcaggaggatcgcttaagcctgggaggctgaggctgcagtgagctgagattgtgccacggcactccagcctggtgatggaaagctagaattcagtggaacaatatcttcaaagtgttgagagaaatacagaggggagaaatgtccaagatttttttgaggggagagtatgttgggattacatgatgaagttctttctataccagggggaartgtgtgatggcacatggctacgagcattggccctagaactaactatactgcctgcattcaaattccagctctgccatttgctagctgtgagaccatggacaaaactctttctccttgtgcctcattttcctcatctgaaaatggggataattacagcacctatatcagaagccagggtcttgacacatttttaattttaattgaggcaggacatagtggctcatgcctgtaatcccagcattttgggaggccaaggtgggtggatcgcttgatctcaggagtttgagaccagcctgggcaacataatgaaaccccatctttacagaacaacacaaaaattatccaggcatggtggtgcacgcctaaagtcccagctggtcgggagggtgaggcaggagaatcgcttgagcccaggaggcagaggttgcagtgagccaaaattgtgccactgcactccagcctgggcaacagaaccagaccctgtgtcaaaaaaaaaaaaatgaaaataatgttaattgaatttttaagttaacacaatgcccagtacatggtaggcgcttcataaatgttagtgcctgtgcccttcagggattgacagctggattaacttgagccgagtggacccagatgcagaagtgcagggtgagatctgcctgtcagtgcagatgctggaggatgggcagggccgctgccttcgctgccatgtgcttcaggccaggtatgcttaaggtggaggtggtgtggagggtggtctgagaatgagcaggagtcccctgggtctcccctgctgcctggcgtttgggacctcctcagtcctggggcacttctgggctggcagtcaggttccctgtgtggacaaacagtccaagctcactgggttgtaagttcctgggggcaaaatcctgttgagtccccagggactagcagcaacagacmagacactcaggatgacaggtgacaggtgagtgtggaggtgtagtcattaaattgtaactgacaaatacccaactcatactggcttaagcaaaagagctactttattggcttatatgactgacatgtagcttcaggcatggctgggtccaggtgttcaaacgatgccattaggaatctgtcttttagctctgctggtctctgtgttagcttcattcttaggcagmctctccccaggtgagagatggccctagcaactccaggcgggcaccctgccagcttagccactccaacagaaaaatcacttctatttcctaccatttccaaccaatgtcctgggattaatttttactggctcaagctggggcacatgtctatctctgaaccaattacactgaataatggatcaggcctgagtcacaagcccattactggagcggagggagggattggmccccactaagtcatgtgagaggggggtggtgagaaggagataggtcctgtcccaaagaaaaatcagatggaagatggatgcaagaccaggaaaacccacaggtggccctctaggggcaccagctcatgggacacccatcttccctcttgcctacttgtcatggccatccctttttcccttcctcagctctctgtcattttgctccctcaaatacctccacccttcccccactcctctctcatcctgtttttctgcctgtttttcacctccccagctctcatttttaggaaaatccctgcccagattggggaggacctccaatttccagcttgctgtgtgaccataaagcccttccttgccctctctgagcctctcccaccgcctccagatttttgcttccagccttggcctcagctggggcttcctagagtctggttgagggagaaccagggaggcaggtgacaggctgagggactcagcagggggcagaggctcctggtcttccttgagcccatggccccttcctcagccacaaggctgtgcaggatccttgcaggcatgagagggactgattgctgtcgcttagcaactgggccagctcctaggaaaccgaagaaggctttggatgctaagcaggggtgggaagggagcaggaggaagaaggaagcagcccctggtgtgggggtggggtggtggtgtgttcctgggtttggagaacgtcaagaaggagggatggggaagctgcctggagtaagacttttgggttgtcatggcaaccaatggcaaggagtccctgcctcatgctttctcttgggtcctagacaaggtgtgggcatgggtgtttgttgaatgaataaatgaaccaagcacccatcacctgccaggtgctatgcttggccctttacacacatcatccaatctaaccctcggctctatgaggttggtctgttattactcccattttccaggtaaggaaatgaagacttagagaggggaagtgactttccctagtgtccgctagccaatgagtgcaaagccaggctttgaacctttgcatcaagtttcccatctggggcctccagagaatctgaggctctcttttccccctccctgctgcacttctacttgctgggctttgtgatgtaggatatgaccttttggtgcctcagtttcctcatctgaaaaatagggatatacaagtgcctccccatagggtggtgacaggaagatactgggtttggacggtcatggttaggggtgtccctagctggacccctacatggaacagtttgttgccttggaaaccagcgacattggaatgatctactcttaacagcctttccaaggcccaacttgggtgccgtgtttcctcactcctttccccatctgttcccagggacctggctcccagagacatctctggcacatctgacccatttgcacgtgtgttttggggcagccagagcttggagacctcagtgagtggtggggaatgaagccaggaaggagtggggcatttggtggtggggcaggagtccccatcagctctcccactcacagaccacttccttygccctcagaccatcaagaagactcgcttcccgcactgggatgaagtgctggagctgcgggagatgccaggtgccccgtccccactgcgggtggagctctgggactgggacatggtgggcaagaatgacttcttgggcatggtgagcctcattccctacaataccctccatggctccccagtgcctccaagggggaagaaagatgagacgggctgagcctcctggctctcagaagggtggatgtacagctgcctcatcaggttcccctggttaggcctgagtgttgcagtttcattgctctgttgtacaggtgaggaaactgaggctgtcaaaggtacaggaacctatccaagatcacaggacgggcccagattctcattctgggatgagagcatgacagatgactatgtgctggccctgtgctgagtgtccctcccacagagcctcattacttaaccttcatggctaccctatgaggctgggactgttgctatccgcattttacagatggggacattgaggctcagagaggctaagtggctttttcaaggtcatatggctaagaaagggcagagccaggatctgagttcagatctctttgactccagacttaacgcccttaactcctactcctggaagtcctgggctcaggttctttctcttggtttccctgtctttggagacagcstggcatttcctcaaatagttaaagatagagttactctatgacctagcaattccactcttaggtacataccccaaagaaatgaaaacttatcttcacacaaaaactctgacattactgttcatagcagcattagtcataacagcccaaaatggaaaaaaactcaagtgtccattatagataaacaaaatgtggtctatcgatacaatggaatattattcagccataaaaaggaatgaagtacagtaagtcctcatttaatgtcatccataggttcttggaaactgcagccttaagcaaaatgacatactgtatgctgtaggaacttaactcttgtttattttttttatttttattttttagaaggaatctccctctattgcccaggctggagtgcagtggcatgaactcagctcactgcaacctccacctcctgggttcaaggaattattttgcctcagtctcccaagtagctggggttacaggtgaacaccactacatctgagtaatttttgtatttttaatagagacasggtttcatcatgttggtcaggctggtcttgaactcctgacctcaagtgatctgcccgcctcatcctcccaaagtgctgggattacaggcatgagctacccacccagccttcattcttgtttatagtaattagctcatggtacatttgatttccttatacgttatgagtcaggacttaccgtactggcacgtggatgaaccattacactaagtggaaaaagccagcccctgcaaaacacatatgattccatttatacgaaatgtctagaataggcaaatctaccgacacagaaaatagattcgtggttgycaggggctggggggcacgaagtgactggtaatgagtgcaggctctttagggctcatagacaatgttctggaatcagcggcacaactaattgcggtaagtctgtgaatatactaaaaatcattgaattgtacacttttaaaaggtgaattgtttaggatgtgaattacgtctctataaagttatttaaaaagagagagagtgtggggcttgggtccctccagggctgtccttatgccttttgatagawgaaatttatgtccctaaacagagctgaaaatacactcagtccagacatgctatctctagcagctgtgtgaccttgggcaaatcactccacatcgctgagcctcagtttcctcaactgtaaattaagtgtccctggtaggccctcagaagccctcagtgtcctggcaggagctaataatttgggacttgtaggagagaaggaggggtcccctggcaggccattctgcccctctgtgggtgggcagtctgttcttccagggctaggtgagacctgagccaggcagggcagggcaggccagggcccggctgagggtctgtgtgtctctctcaaaaggtggagttctctccaaagacyctccagcagaagccacctaaaggctggttccgcctcctgccctttcccagagccgaggaggattctgggtaaatgtgggtgcagagggagggggccaggctggagccatgccgggcagcatccacagcttgcgggcagagcccatgccagcccacacattatcactatgccacttcatgcattcatccatttaacaactgtctatggaatgtctctcaaggtgtttacataaatccacataagttcactttacacccgttcacctgttcatgtgcaaacatgttggttcacacttgatgtatatttagaactttgggtccttccacacctstccatactgttcattcttgaacacacttgtttataccatctccacttgcctgtcctgtttatacccatcaatatcatttcacacctgtttatactggccgcacctatacacacctgtccatgcttgttcacactgtcaacaatcatctacacttgtccacacatcctgtacatatttgtgtacacyggccacatctatccactctggccacacctgcctgtttatgttgtttgtatacattcctatttatgcctgttcacagctgcctacccctgttcatacctgtccacacttgtctatacctgcctacacctgtcttgttttgcaaacacctgccctcctcccatgtgttcccattggcctctcttggctctccacacctgcccatgcgcacttgtgctcttccataagggcatctttcattttcttttccttctttctttttttttttagacagagtatcgctctgtcacgcaggctggagtgcagcggcacaatcttaacctctgcctgccaggttcaagcaattctcctgcctcagcctcctgagtagctgggactacaggcgtgtgtcatcacgcccggctaatttttgtatttttagtagagatggggcttcaccatgttggtcaggctggtcacaaactgctgacctcaagtgatctgcccaccttggcctcccaaaatgctgggattacaggcgtgagccatcgtrttcggccagatctttcattttcttatgatctgatcctggacagggggaacctgggtgccctgcgagtgaaggtacgcctgattgaggaccgcgtcctgccctcccagtgctaccagcctctcatggagctgctcatggagtctgtgcaggggccagcagaggtgggtgcgtcaggcaagcaatgctatcaggcgggtgccgggggtctggatcctggcctccccctgcctcayggagccctatctaggcccatctgctttggggtcccaggggccgaggtcatctttgtctcccgcccccacccaggaggacactgctagccccttggctttgctggaagagctgaccttgggggactgccgccaggaccttgccaccaagctggtgaaactctttcttggccggggactggctgggcrctttctggactatctcaccyggcgtgaggtggctcggaccagtgagttgccygcacaacccccgacatcaccrccctcaatggtgggcttgcaggagggtcctgggggaggaatggggaggcctcaggcagarggaaaaagggctcctttttctgtgggtccctgtgctgtgcacctccagacagttgggagcccaattgcaggttcaggccctggctttgctacttgtrggctgtgtgacctcaggcaattcacttaaccactccgggcctctgtactgtgaatggggttgatgttttgggtcttcctgattcttggggctggaagaatcatgactcccaccttgggtgagtggggtgagctgggttcagctccctaaatcccagcaaacacttcctcctgtcctcccagtggaccccaacaccctcttccgttctaactccctggcatccaagtcgatggaacagtttatgaaggtgagtaggtgaaggcctgcgggaccaggcgcagcttcctcgggtacctccttcccagtgcctacctggctccctcacttagctggcttcagacagcactgagcagccgagctgcagtgctggcggctggtgcccggccttgccctgagttgcacctggatgtgtcccctaccccagccctggcctctctctgaacctcttcctgcatggtcccccctgcgcccagctcatgggcatgccccggcctcgccctcagccccaccccgtgtggtgccccctgcccccagctcgtgggcatgccctacctgcacgaggtcctgaagcctgtgattagccgtgtctttgaggagaagaagtacatggagctggatccctgcaagatggacctgggccgcacccggtgagcaaagcctgaggaccctgaccttccgacgggcccctttggctacccggagccttgtctgggggctgggttcatgctgactgccacccaccctggggctacagctgctcaggagctcggtggctgagctgaaagcctcacacacaagcccttaaaccatcaggctgtgtagtataggggttatggtcaggactctgatgctaagcgccctgggttcaaatcttagctttgccactactggtggacaaagttgccaaaacttctgttcctcagtggttaagttgcttcttttcttttcctttttttcttttttttttttttttgagacaagkttttactctgtcacccaggctggggtgcagtggtgtgaccacagctcactgcagcgtcaacttcccgggctcaggtaatttttccacctcagcctcctgagtagctgggactataggcgcacaccaccaygcccagctaagtttttacatttttagcagagacagggttttgccacattgcccaggctggtctcgaactcctgggctcaagcaatcctcctgccttggtctcccgaagtgctgggattacaggcgtgaacaaccgtgcctggcatratcagattttttaaaattaaaaaacctaaaatattgatccaatgttcttctacttaatgcacacactacttctaaaatgtcccttatccagctggtgagaatattatcacctgaaacgtggggctcatgacctctgctccgttaactgagtcatgcatgtgctccacaagcattagtgatctttattactgtgctgctggggctcctcgacattagtgatatttactgctgtgctgctgggggtccccaacattagcgatttttattactgtggtgttggcggtctctgagtgggcctgcctgcaagggagatcgtggagagctcaatgagattgggaggaagcagagcagtggctgggggtcattccacccctccgtgggctcctcctttctctccagaaccttctcctgtctaacccacaagcctggagctgtggaaaattgttgctggggtatccactggggaccgtggcagagacaggagaggatctttccttgtgctgtccacaccttctgactactttagaggcaggcatcatgaccccctcttactgatgatgcaactgagcctcagagagggaaggtcacttgcctaaggtcatacagccaggaaattacagagcaaggatttgatcccaggccctgagcagaaggacacagtccatctgtgagactccaagttgagggcttttcctagcacacttgataacgatggaggaaactcagtgggcacccatggggacaggggcatgtagggacctggacagggcagggttgcaggcaggctgtggagttggcagtcctgggttctattctcagctgtgccatctccccagtaacctctctgagcctcagttttcttatctgttaaacgggaacaagtaaggctacttaccccatcaagttgctgttaggattaaaagagaccatgccagagacaagtccagggctcagcacgttgggtccaggacacagtggggctgagaacccccagctgtcactctaggtgtgggcaagacagaccctcaatctgtaaagaaagaaaggaacacaataattgcagatggaaaagtgctgttctagcatccacaaaacaaaacaatgattgagtgccaggctctgggctgaacactgacgatacagtagggaacaaatagtcccaagtccctattctggggggagacagataatgagcaactggaggaagaaggtttatttatttatttatttattttttgagatggagtctcgctgtgtcacccaggctgcagtgcagtggtgcgatctcgactcactgcaacctccacttcccatattgaagcgattctcctgcctcagcatcccaagtagctgagattataggcgtgcaccaccacgctgggctaatttttgtattttttggtggagatggagtttcaccatgttggccaggctggtcttgaactcctggtctcaagtgacctgccccctcggcctcccagagtgctgggattacaggcatgagccaccgggcctggttgggaaaaggttattgaatgggaccagggaatggaataaacgagggaggggagaggcctgcaatattccagagggtgaggacaggggcagcctcgcaggggaggggacatctaagcaaagacttgcaggsggtgaggaagrgagtgttgcggagatttaacatttaacgggagagtgttctgggcacggagataagccagtgcaaaggctgcaggatgggaatgagctcatcgtgtttaagcaacagcaagaaacccggtgggaaggggcaggaaggaggctgcggacgtggagggaagatgagtcctctcggagctcagcggggccggtggagggtttggagcaggcagatgttgtgccccgaggctgagctgctccgccggcccctccaggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggtgcgccaggatgggaggctgaggctggggacaggccggagcttgtccggggtcactcggaggagtcaggacagaactgtgaccagaacctaggctgccggcactagagcattctgtcctggcagaagtggggacagcgttcctggcagggtccgggtcccaagaatgatagtaataataaaaataggccgggcgcagtggctcacgcctgtaatcccagcactttgggaggccgaggagggtggatcactttcaagtgaagtgaggagttcgagaccagcctggccaacatgatgaaaccctgtctctactaaaaatacaaaaattaactgggcatggtggctcacacctgtaatcccagctactccggaggctgagtcaggagaatcgcttgaagccaggagacagaggttgcagtgagccgagattgcgccactgcactccagactgggtgacagagatagactctgtctcaaaataaacaaataaataccaataataaatataataatggcagctaacactctatgtagcctgaccatggtccatatcttgttttaggtgatttatgtatttattaccctatctaaccatcacacgcagcctgtgaggtggataccaggattattcccattttacggaggaggaaactgaggcccagagagcttaagtcacacaggtagaaaggagtgatattgggactggcactcacccaggcaggctggctcctgagtctgtgctcataaccagcaaataatagagtctggcacaaagtaagtgcttcttgaaattccagatgtaaaatagagagagagagaggaagtaagagagaagaacgcagatctggcatacagtaagtgctcagaaacacccagaataaagtctaaaaatgaatccctgcaggtgtagtgctataccaacatggatagaaaagttgaaaactcagatgctgtgagtttcaggcagacgaggcgcaagaacaaagcaagcagcgcgtggggtggtagggagwcatgaagactgtggccaactgaagcccccagatcttgtctaaagggggcagctccaggggatcactgccatataggaatggaagcccagtactgccagatctttagagattctggattttatgtgaggttatttatttatttacttattactaacttttgagacggggtcttgctctgttgctcaggctggagtgcagtggcacaatcatagctcactgcagcctctatcccaggcttgagtgatcttcccacctcagcctcccgagttgctgggactagaggggtgcaccaccacacccagctaattatttatttttctagagacagggtctcactgtgttgcccagagggtctcgaactcctagcctcaagcagtccccttgcctcagcctcccaaagtgctgggactacaggcgtgaaccaccgcgcccggcctgatctcttatttttaaaatgtcagcatgaattcacctgaaaaccaaacacacaaraacactttgggwcatgcattacaaaacatttgtggttggactggccagtttgggaccccctggttgaatgctcagcacacctcccgaggtggctgtcattgtcctcacttgcagataacatcaggtgagatgaactcttacgtagtgctgatgtatcagaccaggattcactttgcagaaagacctaagacctgttacattttggcaatgtcgtaacccacttcctayagcctcatttgagagcttttgatttatgccacatctctctccacttcctgtttacagatggggaaactgaggcccagagaggcaaaacacttggccaagggttttctagactcccagctggggtctctcccctcctccccctcctccccagctgaggagtaagctctgggccttgagactgggatgtagcttggcttacacctcaccttgctgggctctcacctgggctgccagcagaggtgttaagtggggcacagctgtggcagggaacagggaagaaagggaggaggccagctccccagacagcctagacctcgtatggtgagccaatatcagtgacacccaagtgtcctctagttctcagcccccaaggtggccctggagcagggacttcctccggcccggggaacccagggaagcccctttctctgctgcactgacaccggttctttgccttcaaaaaggaggaaacaaatgagctgatgtgaagactgaaattaccctggactacagatggcagtggggtagtggtgggacagttcagggctccagatggagggggacagttcagggctccagatggaggggaagatgctccctctgggcagttctaggtacccagctcctacaggggtcactgccaaggccaagatgccccaggaaggtggcacacgccccggggagggcattgtttcatgtgtgactacaacctctgaataaacacaggcgcagactctcaggctaaatatagcctggcaagtgtgagaggtgggtggggagctggtttggggggagcaagatgcacccaggatggaggggcacccttccctgagtcacctctgctggtgctggggaaccagcgttacctttagatgggccaggccccggattcacatggaggggaaccatactctacagtttgtagagggcagaggttggaggtggggaggtgcacacaggatggactctggagcccatcagactgggttcactactgagcctcagtttcctcatctgaaaaaatgggataatagcacttacctacccacatggagttgtttgaggactaaatgtgatagttcaggcttggtttctaatacttagtgagggctccttggtagctggtgttgaatggcaggagagtgtggtgaagaacagagagttcaaatccttggctgggcgaggtggcttatgcctgtaatcctaggactttgggaggccgaggcggctggatcacttgagattaggagttcaagaccagcctggccaacatggtaaaaccccatctctactaaaaaaaaaaaaaaacacacaaaaaaaaacctaaaaacaaaaaaagcaaaacaaaaactggccaggtgtggtggcatatgcctgtaatcccagctacttgggaggctgaggcactagaatcacttgaaactgggaggtggaggttgcagtaagcagagatcgtgccactgcactccagcctgaacaacagagcaagactctgcctcaaaaaaaaaaaaaaagaaagaaaaaaaaaagaaaaataatcaaatcctgcctaagtccaactcctggctctgccgcttatggctgtgcagacttaggcaagggactttcccttgctgggcctcagttgcctcctctgtaaaatggagatgtgatccttcctgggttgagtattaaataagcgaatgtatagagaggtatccatcctgctgctgttattatcataaatcacaggtctgggtttgaatcctgactttgccactcattagctgtgtgaccctgggcaaatcgcttgatgtctctgagcttctgcttcctcatctgtaaaatgggactcatgatggtgcctccctcttagggctgtgctcttggcatagtgcttggcacaaagccaactctgaggacatttggccaaatctgcttttgtaggattggttttgttattccattttccaggtgagaaaactgaggcccagagaggaaaaacttcctcggccagccggtgtggcttcctggtcaattccccatcctacttctctttgcaccacgaatttctagtccttgctgcctcagtttacgcagctgagaagtgggtttggggggctcctcttaccttctgctcctcccagcaggatgtgaagtacctggccatcagtggatttctcttcttgcgattcttcgcacctgccatccttaccccaaagctgtttgaccttcgggaccaacacgcggacccccagactagccgctcactgctgttgcttgccaaggtgccagccatgggtttcccccatcctaggtactttagccagggaaaaaagcatggtaggagcagagctgggaggccagacccacagaagacccaaagaacacccgaagaaacccaagtctgaaacaccacygttagcattccatcccaagggtgaaggcagtcatcatgcactccaatttcccctttgggaatgaaaacccaacccttccagaaggaaagtggaaaacaggctagcaggcattcacaccttagtatgaattagatcatcatttgcaaarggcaacaacttgagattctgcatgagagtaccatggtaggactgagcagttcttggggaggatctgggctcgggagggaacagaataaggttagtggggagtgcagattccaaaaagaggaaggggaaacagacatcacccaaggaaggtgttgagtcttcttattgatttatttttttccttgagacaagtctcgctctgtcacccaggctggagygcagtggcacgatcttggcttactgcaacctctgcctcctcggttcaagtgatcttcccacctcagcttctggagtagctggatttacaggcgtgagccaccacgaccagctaatttttgcatttttagtagagatgaggtatcaccatgttggccaggctsgtcacaagctcctgacctcaagtgatccgcttacttcggcctcccaaagtgctgggattacaggcrtgagccactgtgcccggcaatatgagtcttcttttattgagcactgatttgggagccaggaggggccctaccctctgctgtgaccttggccccggcatccctcgcttctttgctccaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaaggtgagttcctgtggtccggccacatctagcttctcagcccagttgagacaccactcagggacttcccctttccccctccagctcctcagcactaagaatgtgaatctgtgggtcagtcaactaacatttcctgatacttactgtgctaggccccagagatgaacagagctcaggtgctgtcctccaggcccatccccagccagtgtggggatatggctgtgggcaggatcgtggcatggtgtgcatgccattgacaaacatctattaagcgcttactaaataacaggcacagttctaggtgctggggatgcagcagtgaacaagacagagaaaatctgatctcacagagcttttattttgttggggaccacaggccattagcaagataaataagcaagttatgtggtatgttagagagctgtaagtgctaagaaggaaaaaaaaaaggaggaaagaacagagatctgaaagggaaaagttagagagccttgaggatcctggggaagagtgtgccaggcagggcacagcatgtgcaagggccctgaggtaggacacagagcagcactgaggacacccgtgaagaagagtgaactgggggcagtggggaggcaaagaggcaaggccagagaggtgagggggccagatcctgtggggcctcataggccttgggaagaattttagctttgacttggagtgaaacagaatcacaggatgatttgtagcaggaaagttgtggttgagtccataccataatgtggggctcaggtcataacctagttggatcccagtcccattgaagcaacctgtcagaacgtagaacctggctgtggcatggtggggtccctatggtgctggggtggggtggcggggctgtgtcctggctccctgagcatgattaaatgctggacattgcctggatgggaccccatagggtgtggctgcccctgctggctgcctgcatactgtctgcagatttctctggttggagagaggtcttcaagggctactctgccctccccctcctcccagcctccatgattgcatcccctattgagggagtggtctgaagtcattgcgctcatcctcctgcctctaggggagcagagaaccatgcccgtccactgaggtcctccctgggcatgctagtggagcaaggtgagcctggttagggagggctcactgtccaccgctctcttctcccatctcctagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctccttctccaagagtcctgagtggcaggtggggttccagtccactatggagggctttccaggggtggcctttttcagtgtgctgcctctttgtacccagggggaaactgaggcccacagtggggcaaggccccaagatgccatagcaacttaacaacgacaaactctcaggacaggctctgctcacaagttcaggccaatgtgggcacaggacatggacaggcaccatcatgcatccttcagaatgtgcacatgcggtggcggggatacgcctcccagatgtggatgcacacaggacagggatgatgctgagccgctctccaatgctcccaccaggatctagacacatgctagacagactcataaaattgaatgtgttcactaggaacgtgtgcagatgttcaggcacatccatccaagcattcattcactcgttcattcattcagcaaacatttattgagtgcctattatgtgccagtgtcctaggcactggagatacagaagtgaacaagacaggtgaaaatcctgcccttgtggggctggcgttcatgactagaatgccccgagacacgtgctggaatctcccgaatggggagctgtgtgcacaccagtagatgatgacggctaacgctgagaagggagcccacgcttcctgtttctattttatcagaagaatggagattctaggggtcagttctctgggttccaattttgggtccacccaatgagtgaccttggaagcgtcatctatcctcttgcacctcagttttctcatctgcaggttggagagaataacagaaccaaccccagaagtttgttgtgataattaaataagttgatcaatgtaaagtgcttggaatcgcgtcccaagtaccatagaagtggtagttattattaacaaggaaatggatgcccagagaagttgtcacttagagaggtggctgggcacggtggctcatgcctgtaatcccagcactttgggaggccgaggtgggcagatcacttgaggccaggagttcgagaccagcttggccaacatagtgaaaccccgtctctactaaaaatacaaaaattagccgggagcggtggtgcacgcctgtaatcccagctacttgggaggctgaggcaggagaatcgcttgaacctgggaggcggaggtagcagtgaggccagctcgtgcaactgcactccagcctgggcggcagagcgagactctgttaaaaaaataaataaataaaaattaaaaaaataaaaggggatagggcaggactcatggaacagctcacatggatggatggacgagcacacagagcacagacttacagggttgaatgtcccgccgctgggaactgactccacctgctgcacacaaccagacggaaggtgtccccaccccggccctagcccccagcccatcctgcagcgacaatcctcttccccagatgtgycactccatccccgtgtctcacatccgcgccgtggagcgcgtagacgagggcgccttccaactgccccacgtgatgcaggtggtgacgcaggacggcacgggggcgctgcacaccacctacctccagtgcaaggtgagaccccaccgcgatggggagcrgggggcgtccctctgttcccacccgccccctgatckcctcccacccgctgcagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcaggtgagggggcagggcggactgcaggctccgccctccccacccgtcaatcagcgggtgtcccacttccgcctgggctggctgtgcaaccttgggcaagttactcaacctctctatgcctcagtctcctcaactgtgaaatgaggttgataacagtgcctatctcgtggagttgtgataattaaatgacttgatttacacaaagagcataggacgctgcttggcgtatgcgacgtgttatttctaaagtactcactaggtgccagcatccagtggtactcaaacatcatgagcttgttctcaagaaagatgagtgcataacccaataattttttttttttttgagacagagtctcactctattgcccaggctggagtgcagtggcacaacctcggctcactgcaacctctgcctcccgggttcaagcgattctcctgcctcagcctcctgactagctgggtttataggtgcgtaccactgcacccagctaatttttgtatttttagtagggacggggtttccccatgttggtcaggctggtctcgaactcctgacctcaggtgataagccctcctcggcctcccaaagtgttgggattacaggcctgagccaccgtgcccggccttttgttaatacaatgttatacattgttattaacaatgtatatacaatgtataacaatgtattacaatgtataacattgtaaataataacattgttattatataaaataatatataatatatataaaatatatataaaataatatataaaataatgacattgttattaacaatgtatatacaatatataatgatgtattacaatgtataacaatgtaatacaatgttataagtgccaagatgagacgtttgagattccagtggatgcctctgacccagcctcaggatggggactcaaggagggcttcctggaggaggtgctgcttaaatgtgacctgagtagagcagaagttaagcagcggcattggagacagaactgggagatgggggtaaggaagtgttgcaggtgtcaygagcaaaggcctagaggttgggacaaggtaggctgacggatggaaaagggtctgtgtgactggagcctagaatgagggaggagtaccgggagaggcgaggctactgctagagtctggggagcagaagtggggctggatgagagtggaggatgtaagattcaacggaagtagtgggtttttttatttttgtttttgagacagagtctctgttgcccaggctggagtgcagtggtgcaatcatggctccctgcagcctcaaactcctgggctcaagcagtcctctcacctcagcctcccaagtagctgggaccacagaygtgccaccatgtgaggctaatatttttktgtgtgtgtgagatggagtctcacccttttgcccaggctagaatgcactggtgcaatcttagctcactgcaatctgtgcctcccaggttcaagagattytcctgcctcagcctcccaagtagctgagattacaggcatgagccaccacgcctggctaatttttgtatttttagtagagatgggatttcaccacattggccaggctggtctgaaactcctgacctcaggtgatccacccaccttggcctcccaaagttctgggattacaggcgtgagccaccgctccagacccaagggtaatttttaaattatttgtagagacaaggtctcactatgttgcccaggctggtcttgaactcttgggctcgagtgatcctcccatctcagcctccaaaagtgctgagattacaggcatgagccaccgtgtgtggcctagaagtagtaggtttgaggagggattttacaggaagaaggagcacggcttggcgaatgcctggctgtggaggcttctggaaggggagagggagttactgatgaatgaagctgtgtyccctcagccgccggctgcagccgtacacactcagctgtcaccctgggggactggagtgacccactggatcctgatgctgaggcccagacagtgtatcggcagctgctcctggggcgggaccagctcaggtgggtgcccccacccatcccacttcacctcctatgaccagccaggccagccccccaccgtggccttgctgtgtccatttattcattcttcccatgtgtgttggtggatattccccgggggcctggcccrgggtggggactgggtgtctacacagtcagggcttgggaagcatcctcagtgggaggggtcccttatgcagaactgggtcttgggatcttttaatacctggagctccagagaccctggcacaattcacataaaatcctggccccctgcgcttgctaaatgaccttggatagatctcttccccttcctgtcatgaggatcactatcactgttatttggtgacagagatttgtcccaactcattatagagtgggttctgaagctgacctgtctgggttcaaatcgtgacctggccacttactagctgtgtgatctctttttaaaaaaatttatttatttatttacttagacagagtctggctctgttgcccaggctggagtgcagtggcatgatcttggctcactgcaacctctgcctcctgggttcaagcgattctcttgcttcagcctcccacatagccaggattacaggcacttgccaccacgcctgactagtttttgtatttttagtagagacggggtttcaccatgttggccaggctagtctccagttcctgacttcaagtgatccacctgtctcgccttgccctctcaaagtgcagggattacaggcatgagccactgcacccaaccagtgcatctggaaaagggggataataatggtggcgacctcgtgggttgtcctgaggatcaaatgagctaatacaggtagagcactttgtaggtgcctggccagatagttagctttcaataagtgataatgatgctgctgctgatgctgtgtgaccttaagcaagttacctaacctctctgtgtctcagtgatcatctgtataatggagctaatagtaaatacctacctcatatgagtttgtcatgataattaaatgagttaatacatgtaaaaggtttagaatagtatctggcactctagaaatgtttgctgtgtagatgatgatgatgatgatggtagatggtgatggtgatggttcaggaaaactaatttctcagagaatttctggggtaggaagcaggaatgggaatcagggaccagacttgtctttctccctcttaccttccaggctgaaattactggaggattctaacatggatacaactctggaggcagacacaggtaagggctcctgtaccwcagaaggtaaaggctgggtgcagtggctcacacctgtaatcccagcactttgggaggccgaggtgggtggatcacttgaggtcaggagttcgagatcagcttggccaacatggtgaaaccctgtctctactaaaaatttaaaaattagccgggcgtggtggtgcacacctgtgatcccagctactggggaggctgaggcatgrgaattgcttgagcccaggaggtggaggttgcaatgagctgagatcatgctactgcactgcaccctgggcaacacagcaagactctgcctccacccccaaaaaaagaagctaaggggttaaggaggtccctttttcttcgcaggcacttccccactgtctcctgtgtcctcctgtttccrgtccattatcaggccacagggctgtgtgtggggattctcaaggattttagggttctcagggcacaaggcacatcttcagcatgagaaaccattgggtccgggttacagcagcctgccctggactggctgagcccctgtggcctcttgtctccctcctaggggcctgtcctgaggtcctggcccggcaaagagcagcaactgcccgcctgctggaggtgctcgcagacctggatcgtgcccacgaggagttccagcagcargagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaarccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctytgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgarggtatatgagggcaagaatcagggttatttaacagattccgtaggtcatttggatgagtatcagctttgaggaccacaggcctggggaatgggcaattttmttttattttgtttttagagttgggggtctcactctgttgcccaggctgcagtacagtggcatgatcataggtcartgcaccctcaaacttctggacttcagtgatcctcccacgttagcctccagagcagctgcgactacaggtgcaagccatcacgcctggctaatttttaaatttttgtagagatggggggtctcactatgttgcccaggctggtctcaagctcctggcgtcaaatgagcctcccgcttcggcctccttagttgctgggattacaggtgtgagtcagtgcctggcttgcaattttatatgccagagtttgggttgaggttttgtctgagaatgaaccacggagtacaaatgtttgggaacatgtgactggcagaactggaagggcctccaaggactcgtttccggtgttgtgtcactagggggtgggacagaaaccaaagcctacctggcaggggatcaagtggaccaggaaagacacggcgctatcccgagggtggccagcaggggttgcccgaagccgcagcatccaccagaactacaggggcgtcctggcatgttgcagagaggctgatttaaggctggggtccatccctgtttttccctagttagaacctgaccctcctccccaaggacagggtcctgacaagctctgagatcctgatgagctgatcacagtgtctcccagctcctccgtatttccctcgaggctcccagctctgcacctgagttccttgtttcttgtcattgtgccagggagcagatgtgtgcattgccttgtgctcttgtgaaagagaagggcactttcacctctgcattcttggagactaggactaggagggtctgccactgcttcagcgcccccaccccttccagcccgaggcaaggaccctgaagtcattctcttgcaagccatcactccccaacggggctgactgcagcccccaggaacagagccacccacccctctcttggcaggaaaagaccaggcgaggaggagaaagaccatttatttctccacccacagtgggactggtaggttttgaaaagagcaatcgctggcatccctttaaatcttggctgactcccaccgtggcagccaatcagcagaggcggagctggtgagttgcctgggcaacaggcccctggttggccgaagacaattagccaccccactgcccactcccaacgaaagggaaattgactctctgctgtccactctgctttaaaatacatcggcccaaactaggcctcctcctttcgctcctgaagtcagaagcgccagcctttggctctcaaaattgggagcgatttggtggagaggatggggtagggaggatgggagaacagcgcctttatctgggacagacagaaggcctggagatgggaagggagaaggagatcagagtccagagagatgaagaggcacagacacaaaatcaggaccctctagtccccgctcgtgctggccattttttgtagaactgctcagtcatctgggggcttccaccccatgggcccacaattgcccaatcagtgggtggcagacatgggtgatgacacggaatgggtgaggcatctggggtacactgagtttcccgagtccctctttgccccccgagccctggcaggcccctaagggcttgccccgcatcctccagtttgcagacaaggctgtacagatgcaactgagacacagatggggatccacatgggggggtcatggggtctttctgtctcttctcttccagcctgggggcaagtacaggcacgtgggtgtgcgtgcatgagttcaacaggacatgtgtgtttgtgtgtgagggggcgggtctctgtctttttggtagggaggtttccagtactctctgcttggccctctcagggagctatgattcggggccagcctgacatgccatctctcttcatcccagctgccaccaggcaggtcccctgaatggctgcggccccttccgcaggctcctccccagccctgaacctgggctaccaggacacacctggcgaaggaggcatttgccggaccaggggcaaagcaggagggaaggtgggcagccttgggcctcaagccttggctgcagcctcggatacgccctgggctgtgagctcagccagcacgttgtctaggtagctagcgtccgggtagccgtggcccgtgaggttggatccaaactcggtcttgtggtggatctcgttccacaccacggtgtccgactcgcccgtggtgttggacgtgccgatagtgaagatgagtcttctctcccaggccgtgatgagcagccgcagcacctggggggacagggacacagtggggccgggaggaggtcacaggcagcttccagcccaccagcctcagcctccctccctcccctgccacatcatggctaccttatggcttcgtccattagcaccaactacgtactgctggcttggccatttcctttgcatttgtatttcctgaacttccagtaaaagctctttccaagttacttatgtttgttttttcttttcttttctttccttttcttttttttctttttctttttttttttttttttttgaggcagagtcttgctgtgttgctcaggctggagtgcagcagtgcaaccagagctcactgcagcctcgaactcctgggctccaacaatcgtcccacatcagcctctccaagtctcactatgttgcccagattggtctcaaactcctggcctcaagtgatcctcccacctcggcctccccaagtgcagggattacaggtgtgcaccactgcgcttggcctgcctgtttttttttttgtgatggagtcttgctctgtcacccaggctggagtgcagtggggtgatctcgactcagtgcaacctctgcttcctgagttcaagcaattctcctgcctcagcctcccaggtagctgggactacaggcgcactccaccactccggataatttttgtatttttagtagagacggggtttcaccatgttgtccaggctggtctcaaactcctgatctcgtgatctgcccgccttagcctcccaaagtgctgggattagaggcatgagccaccacacccggccctgcctgtttttttctggggtgaagaaagcatctggcagctctctgctctatttagtttggactccacactatattaaagagccacttgtaaattagttactaacattcaaaagcctagagatttcccatgaaaatctggatttcttggtgctcttgaaaagcagaaagtcaaatcagacaacctgtagggtggtggtgacagcttggactgcctgggctcaaatcccagctccgccacttagtttctctgtgaccacagtcaagtgacttgccctttctgaagccttgtgtctttgtctataaaatggggtcaggatcttgacctcagtggctcaggaaacgagataagatgtgtgaaggaggtggctgtggtcgttactgtttgggtgctgcttttgggaggaatgtgagagcagggattgggaatgatggggaccacaggcccaggccagtggttgctggagcccctgcctgtgcctatctcccatgccctcacggctgggcacccaccttccggcctttctcgttgttgggtagatagcagtggcgagggaatcctcttgcggtgaacttcttcccggggttggggtgctcagggccctgcaaagagggacagtacagggatttagaccatgaacaggtggtggcagggtggagaagcatctggaggagttggaggagtgtgggggctgggggccagagaggcggaaggggagcccacctggatgcctgtggggatgtcatagacgatgcggatggtctgggtatcagggaagccgggcagcgagtgggggatgaggtggaactccatcttcccaggcggctgcgtacccgtcttctccccrtagatggccttgcaggtggggcactgcaggctgccatcctgggcaggggaggctggcagtgagttcccagcacccccccaaaccccactccgttccctgcccactcctcagccattgtcccgcccaacccaccttgttgccattggagtacatggccacgaggcacagcaggtggtacatgtggccacagcggcccaggcggcccacgagctcaggccgcacgcccttgtgccgaagcacgccctcgtagcctgatgctgtgaccagycgctccatgcagatggtgcagtcctgcaggtggcagcaggggagactgaggactggggagggcagggcacctactgggtcagcactgccccttggtgggtcaccataggcagcagaccacactctctctggtacccatttggcaaagggagacaggacacaccctctgccccatacattgttttattttcttttcttcttcttcgttattttatttattttatttatttatttttattaagagacaggctctgttgcccaggctgaagtgcagcagtgcaatcatagctcactgcagagtcaaactcctgggctcaagagatcctcctgcctcagcctcctacgtagctggaactacagggatgagccactgcacccagccccttcccatatattgaattctgatatatcacagaggaagatggctcccctcaccaccccccaggtgaattaagggcttaactatcaaaagcaaaacttaaaaacatttagtggaaaatatgggtgaaaatgacacaaaaactcaatcatcaaaagatggataaatgtgagtctattaaacgtaagtatttctattcatcaaaaaacctcataaagtgaagaaaggaacaaactagaagagctctgtatcacccagaacccaggaggaggggtgagggttcctgccccctccatgccagggccctcccccagcccccccatcccctcctcacctcatcaggtgggtttttcaccttctgcatgtatcttcgaaccacatcctcgggattcttacctgcagggacacagcggggtgggtttgagggtacccagagtctgtccccgaaggcttggctcagaactgggtcaggggtcagagggcaggggtcaggctggcaagggttggccggggtcaggctggcaagggttggccagggtcagaggtcaggggttgctggaggttagctgtaacaggagctggtgaaagatggggccagggcaaggggagctgagatcaggcaatggaggtgaggtagtaaatgctaagaataagttggagaccaggggtcacagagttgtggtcaaggcttagtggggttcatctcgtgtgaggcagggcgtggagggcgtactctttttaaggtgcttcttcttggtcttgcggcacaccccgggcacgccaggcacgggcttcacgtcgctcttgctcacgggcggcgggtgcaggatgggcttgggggcccgcgtcaggcacacgggcagcccggccgcgcacagcagtatcccggtcatccctgggggttagggggcgcagtcacagggcggggcgccatccccgcccagacccccgaccactggccctgggaatcccggggccctcgggtgggtgggagggttgcgctcttgggccccacccactcagccccttgaaggcccctgaagggcctttctgcgggccacgcccgccctgtgtcctgggcccagtggaagggggcgtttcctccgggccacgctcaccagcccatctcgggggcggggtcaccgggtgacaggcggagctgcctcctagtgggccccgcccttctttcccgccctgggccagacctcacctgccagggccggatggaccggcccagtaccattcaagttcttcaccgggagtgcggggaccctgcggggagaagagaagaggccgcagctggactccagcccccgaagcgacgtcaggggacctggctcgccttctgtctctggctcctgggccacacaccctggcctctttgtacctctctctgccaactgcagttacctccaggaaactctctttctactctgacatcctattatggggcgggggtggccaggacctccgcccaggttccaatgggatgcacccttagactttagtgcagacacctccttaccctacagccggctcctccctcgagagggcgctttggctctgagggctcctttcgttggcc

SEQ ID NO: 10755 - DNA, 19959 bp, Homo sapiens
  misc_feature (1)...(19959): n = A,T,C or G, or insertion/deletion polymorphism (see Tables 1-2)
ccccctgacacccaataaacacacacacacacacacaccacattttccttctctgtgttgggtcattcccatcaacacacaaatatgctacaagatcttttatcttactgaattattctctgcctttggctccatttctcttcttctctttccataaaatttactgaaagagacacacacacttgtttcccattcctcacctcacatttgcttctcaacgcactcaaacacactcaaacctatcaccaaaactgcttttgaccaagttatgaggggtctgcatttattgacaggtgacttcatggtcactgctcaatctatgttctttgccatcccccttttcttcctaggtgatctcatccagggctctggctaaagactctatcaccagctatggcttcggagctccagatgtgacaatattcaactagatacttgacatttcttggaggcatttcaaaacttcaccttcccatatcgaatccattggcaagtcctgtgagttcctccaaaatagaatcctaatccatccaccctctccatctccacagttaccattctagtctaagctaccatcatctctgcctaaactactgtattcacctcctaattggccttaccggtgtggtgattgcccaccttttcaccacataatatccaaagtgatctttttaaaacatgaatcagatcctattaccctcctgcttaaaaccctccagtggcttcccattacactaagaatcccaactcctcaccaggacctacaggacttggcatcttctctttctccctgacttcatctttcactttttcttacttaccctgttccataaccttattttccctgcttgaacatgtgaagctcctccccacccatgcttgtccatttgcattgcaataaggaatacctgagactgaataatttataaagaaaagaggtttattttgcctcacagttctgccaactgtatgagaagtgtggcgctggagcatctgctcctggtaagccctcaggaagcttccaatcatagccgaaggcaaagggggagctggtgtatcacatacagagagagggagcaagggagagaggagatgccaggctcttttcaacaaccagctctcgcatgaactcacacagcaagaactcactcattgaggtgaggacagcaccaggccataggtgagggatctgccctcatgacccaaacacctcccactaggcacatctccaacactggaggtcacattttaacatgagatttggagggataaaaacatccaaaccatatcactacctcagtgcctttgcatttcccattgggagaatctccccgtggatattttcaagttcgttgccttcttattcaggtctcagccattcatgtcatcaccctatcgaaaattgatacccctaatcccacaccatgtgacccacataaagagagtggggtcccagcaggaaacagatgacacacacaaattaagacatttgaaaataattgtgtaacagcatggacagaatgaagggaaaccacaaggatagtacacagaactgtggagttggcaataatagagtgctgttaccatccataggcttgaatgaaacccggaaacacataagactacatggagaggaccttaggttggaatacagccagtacacagagaccagcacctcactctcctctcttcttgcagtttcctgccagtgctctccactggttgaatccacttggaagcaggaagatgagggaccttgttgatgtgcaagccagtcaatcccccagggtgtggacagtggatctggacaggctacataagatatccagcccactctcttctcattatcctgccttgttttctttattgcatttatcactgtctgacattatttatgtgtttacttagtatctgtctcctgcactagagctcgggacataatagaagttcaataaattatttaaaaatcaagttaatctcattttgaactctggaagttacaatctgtccaggcatacatgccttatttataatatttaggacactgatgttaaagatgattttaccagccaggtgcagtgcctcacgtctgtaatctcagcactttgggaggccaaggcaggaggaccgattgagctcaggagttcaagacaagcctgggcaacatagtgagaccccatctctacaaaattaaaaattaaaaaattagccaggcatggtggtgcatgcctgtaatcccggctacttggggagaataaggagggaggattgcttgaacccaagagtttggaggctgcagtgagctataccctgtctcaaaaaagaacatttttcctacacagtagttttgtgatttatagcataaatgggttttaaatggaaaacacagcacatacattcttatattcaattgggtagagtatttggggaaactggaaacaacaggaagtgggaaaaagagtcagaagaagagggtaattttggatagcagcatatctccatgcccatcgtggccaatcttttgcttgctatctatgatatattataaaactgtctgtcaaattgtcattcttcattcatctgtatttaaaagttatgtaaatcaataaagacagatgatttaaaagacactatgaaccaatgacctacttaatatttatagaaccctaaacccaacaactacagaatatacactcctttcaactgaacacggtatattcaccaagatagagtgcatgctgggacacaaaacaagtcaataaatttaaaagaattgaaatcattcatgttttctgacacaacagaattaaactaaacaccagttacaataagatatctagaaatcccaaatatttggaaattaaaaacacatttctaaatatttcatggattaaaaacataaataacaaagaaattttaaaaatattttgtactgaatgataatgaaaatacaacatatcaaaattcctgagatttggctacagtaatgtttggaaggatagttataactttagatgcttctatagaaatgaaggaaagaccaaaatcagtgacctaatattctattctaagaaactagaaaaagaagagaaaaataaactactttatgtttaagtagaaaacataaaataataaagataagaatatgactggtcacggtgacttatgcctgtaattccaattatttggaaggcataggcagttgggtcacttggggaccagttcaggcaacacagtgagaccccatcactaaaaataaaaaaagagagaaaaaagataagaacagaggtcaacaaaataaaaaataagcagggaaaagtaataaagccaaaagctgtttctttgaaaagattgacaaaccctcaattacaatgatgaagaagagaacacaaatcaccaaaatcaggaacaaaaatgggctattacaacagatcatacagacattaaaaggttagtaagacagtatttataaacaactttataccaagatatttggcaacttagacaaaatgaacaaattccataaaaatataacttaccaaacaacacaagatgaaacggacattatgaatagccctatatctttaaaataagttgaatttattatcaaagaaaattacaagcccagatgttttcacaggcaaattctatctaaaaaattttaaaacatacttcaaaataaatgtgggatgacaatagcatatattaaaacctacaggatctgaccaaagaggtactcataactgagtagttatgtcagaaatccaaggacggtcaacatttgacaatgtgtcatcattcactacatgaataaatgaatagaaactatatggtcatctcaataagcagagaaaagcatttgatatttatcattcatttaaaatttaaaacaataaaaatttttggaaagtcaaaaatagaactttaaaaaacttcataaagtatacatacctactagaaaactacagtaaatattaaacttgaaggcaaaacctcaaaaatagaagaatgcagtagacttaaaccaatatgggtagatcttcaagatgtatttttgaggaaatcaaataagttgtggatccttataatattttaacaatactcacacaaaatactatgtattttctataaaaacatacgcgggtatgtaaatacataaaaataaaactggcagaaaacacacccgtctgataacttctgagaagcgccaagtaccaggattggtggaagtacaaggtacggtgtttggttaagggtgacttgagctttagctaccatgtttctatttgtataactttagatgcttccattagaaaagaagaaaagattaaaattagtgacctaataacctactttaagaaactagaaaaagaaggttttcattaattacttagctaaccaaaatttaattttaataccataaatataaaaaaactgtaaaaatatacaaaaactgatttttttctttttttagacaagtacattaccataggtaaagattaaactagttcttttgggttctttgttaagtttggagactataaagaaactttcttgtatgccacttattaatacatcctggaactgaattgactccatttagcaagtcaggtaaatctagattatgccaaattatcaaacaaacacagagtctgagagaaaacctctagagtttgctaacattctatatgatatgaacgaaatagagacattggtagatactctttctctttatttctttcagaatagaacaaattagtcccgcagctactggcgattggctgaattttttttttttttttttttttttgagacgggatctcactctgtcacccaggctggagtgcagtggcggatctcggctccctgcaacctccgtctctcaggttcaagcgattcttctgcctcagcctcctgagtagctgggactacaggcacgtgccaccaacgctcggctaatttttgtatttgttcttttttagtaaagacggggtttcgccatgttggccagattggtcccgaactcctgacctcaggggatccacccgcctcggcctcccaaagtgctgggattacaggcgtgagccactgcgcccggccttggctgagtttttattagatctgagccgttcaatttcaatagtttaggatccaacctcactctcaggcaaagaatagaggaaatgataccaacgtatttatctgtcaataaacacttggtgatttgaatatggttaagggattcctgtagtttgccccccttaaaactgaactttgtccaaacctgttctaaatatgtgtgtgcgtgtgcatgcatctgggtgttggggaggagcggtcgtaaagttccttttaaatttcacctatgggggactacttcccacctcatcctatgaagtcaacattagcctaaataccaaagccagattaagacactacaagaaaactacgaaacaatatctctcacgaacacagatgcagaacttctagacaaaacgtttccaaattgaagcgaagaccatattaaaaggacaaaagcacctcagtggttgcttggggactgggggaggggctggattactatcttggctgtggtgtcgaaaacctatcaaattgttcactttaaatatgtgcagtttattgtatcccaaccattcctcaacaaagctgtttttcagaaacatttgtccatgtagttttgcctttgaatggttgggtcaatgaagagaaaaacgagtgaaaacagggaatcatgacactttgtttttttacgtgtaaatattcgcaaaacgcccaaactggtaactttgggaacacgggttcacgcagaagaagggctgctgtctggggaggactgaaactcgggttcccgaagtcgggctgctctggggccacggagagaaggggagagaacgtcgaggaagaggcagagctcaagtggacggaggatggaacacagagcgcggccgggacaaaggggcaggccagacagccgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagggcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggtgagagggcgggacggcagaacgaggggcacctgccttcggttcccagacgccaccacggcggcgggacgcnaagcggagagcctgaggcngactgccggcctgagatgggcgggcccgggtgggcagggactgaggtgggcgggccgggtgggcggggactgaggcctcggaggggtttaaggaacgcgggccagaggcgggcggggccgaggttggtggagtccgaggcccgctggaagcctgaagtgggcggtggcttcaggtgggcggggcctatggcctctttcccagtgtccgctgcgctgccgggcccgcgaggccgagctcgccagccggatgtgtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaanccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggtgagtcccgccggcgttattaagggcgcaccagtgatcagctcaacaccgtgctcaccaaagaggccgaccgggcctccctgaagtcagtgtccgacaaatagggaaacaaagcggtttccggaaggttgcatgctagggaaacaggagatcagttgtatcatgactcggaaccgtgaggcgggaattacaacctttttgttcaagtaaaaataatgcagttagtacaaaaagataatgattatggaaataagaggtgcagtcattgaagacgttagtcgtcctggagggagtgtcacaaagtatatgatgttgaatttgtctttgaaactacaaggccatttttaaaaagccattgaatgtgaggtcattcattctcattgtgatgacattcagcttggctgttgggtgtagtacgggaaagagctgaacttcgtttctgcctctggctctmccacttactggctttgggaccttgancaagttccctaacaattttgctttccttgtctgcaaaaatggaataatgtaaggaccccacagcatgtggtatagaatgggcctttcataagtactgactacttgggtgggaagtgttgggagttagctaactagaactccctcaaacaattcttttctgaacttagtttccagccctccacacacatgagaataagcttatagttccttaaggccaggaacccagaagttatgcaggtaagtttggcttttatcagttgaagggtagtgaatagaaacttttcccattttcaggaccctccgatatgttccagaggaatccaaagacaaagttatctcagatgaagatgtcctaggaacattactgaaagttttccaggctctattcttaaatgatttcaataaacaatcagaaatcttgwctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtaacagcacgattaatattatactttgccaagcttcttacgtattgataaacataagttcagtaacatacccagccttgcaatccttagagtaagggattaaattggaaactcgagtttccatagatttttgcaattctaattcggaaattaactgtttgtaaattgttttgtgttagaaagtatcctggagtatttgttgggataaatgcactttttctttcaaggaaagctttcctgtcaacgtttaaatttagaacatagtatgacccactttgacaaattacttaaaaagcactagagaaacatgtcagtttggtttaattgatagctaaggataaaaatggyatggataggctcacgccggtaatcccagcactttgggaggccgaggcgggcagatcgcgaggggtttgagaccagtctggncaacatagtgaaaccctgtctctactgaaaatacaagaaattagccaggtgtggtggtgtgcacctgtaatcccagctattcaggaggttgaggcaggagaatggcgtgaacccgggaggcggaggttgcagtgagccgagattgtgccattgcgctccagcctgggtgacagtgctaggctccatctcaaaaaaaagaaaaaaaaaaagcgtacggatcaaaacataaaagacaacatttaaacccataagtcaccgaatgaagaccttcctgccctttctacacttggaaagtaaggcaatttcttggcacaagatcattaactagaatgctaaatagactacgttatgtgttaaactaacattatattatttggtatagtggaaagtgtgtgtgtgaatatttgagtcagatagacccaggtttttaaaaattcattctcctgttttctaattttacatccccaaacaagggagtttcagtttcctgctgtacgagtaatctaattttgtaaagactaaatagaataaataaattaatactaaaagaagtttaataaatagattaacatgcctggaacataggaagcactcggtaaatattttctcatttcgtcttttkccagtgaaaggagaaacagccttaatgtcagactcatctattcccatatgtgtctacattatttaattattagcaaaataaatttcttcaaactctttagatgttaaatcacattctacttaaatayatatgtgtgtgtgtatatatatacacatatacatataaatgtgtatatgtatatatatgactttgtaaaactgagcctaaaatgtgatgttcatattatcattaaccaagatagccatattctgttttgctgtgtggatgagttggttctgtgctccatctgctattgggcgttcacgctttaagagggagaaagtaactaaagagaatgtgattatattccaaagaagggttcttatcgcagtgtttatgatttttcatgttgttatcatatttctttgtcttgttgtgtaataggtacagtatatcagaagtatgagccgatctttttccagtccattggaaatccgtttatttttagatgcctggatggggtactcattgatgggaatgacaaagggatatcaaaagttgtgtacaggtaagtgatgcccatgttcaaatttaattataggagacagaaccgcacttaccacaatgattatgactaatagcatttgtactttatttattttttatataaagagatggggtcttgctatgttgtccaggctggttttgaactcctggcctcaagcgaccctcccatctcggccttccaaagtgctgggattacaggcttgagccaccacacccagctcagcatttatgcttcattttattattttttttacttttttttttttttgagacagagtcttgctctgtcrcccaggctggagtgcaacagtgcgrtctctgctcactgcaacctctgcctcccgggttcaagtgattttcctgcctcagcctcccaagtagctgggattacaggtgtgcaccaccaggcccagataatttttgtatttttagtagagttggggtttcaccatgttggccaggctggtctcgaactctagacctcaagtgatctgcctgcctcagcctcccaaagtattgggattacaggcgtgagccactgcgcctggccagcatttatactttgaataaaattctgtttagatagctgctgtgtaacaactcagttgccctactgattatactaaagtcttttttttttttttttaagaaaaaatgcactggtgtaattctagggttttgtattttaggattctattttaagatacagatccattagctaatgctttcacttgtttcagatcttgcaatgggagggatcgactcggccctttanaaatgagtgatagtacatggctaacgtcagaaattcataaccctctggctgtgggacagtatgtcaacaattgttccaatggtaagaaggcatcatggggctgtgagatgagatatatcaatggctaattctactcctttgtcatatgactgagtgccaagggcagttgagtataacatataataagctagtcaagtccttaagcaactctcacttttgggggatgatattagagagaattaggggaaatcttgatatacattatttagaattgtttaatttactatttttcttctgattttgcagtgaatataggcaattgataactcccctttgatcattattattttagcattttaaaaatagaaattattatgtcagtgcttcaatatagccttatagattaatggctagactagtatctgctttctgttgctaagtttgtgagtccctatctatatcttctttaggagttgactttcccataggtaaaagtttgattgtttgaatacatttaacatgggctttggcgttagtgagaaacgaagtccaagcctgactcttttattagtatttaacctttaacatttctgagcctctatttcctgatatataaaaagtaaacaataaaacatacatatatgtttattatgtatgttggtagatattatctaaacatatgttattatatatgttgtttatgcaaaaagtaataaaacatgttttatatatgtctttttgaatattttattttatatatttatgatttaccatatatatctgcaaatatatatacgtaaataaactctgacagtacctggaacatagtagtaattattttgatcatgttttgataatttagaaaaacagacattgagtgtcataattcaattctgttttccatgaccttgtataatggctctttttctaaaaatgatgtgcttgttcctagacagagcagctaatgtctgttatcaggaatttgatgtgcctgcagttttccctatagaactgaagcagtatcttccaaacattgcctacagctatgacaaacaaaggttcgtttgctaaaagagcatttcatatcttctgcttatgctgtacttaaaaaaatatagaagaaaaagctatgtagaatttggggtaaaattttttttttagtgaaaaattataactcagatttttatrttcacaccttaacgtgttaatgtaggcttatttgaaatttaaaattttcctttaaactagctcattctgtttatttttacccatttttattctatggcaatacttcataagtatccaccttaaagttttttcaaataattctgttgtttttcctacctacaaaatcttcaaatatatctttactttaatcatttataatatcatgttctctaccttataagaaagcatccaattgaagaaagaggccaaattacactatgattcctttgccaatttcactattaggttcttaataatgaaactaaataaaaaaggactgtattcagaagacacatattttaacatagcatttatttcctgttcattcagtggaaagtctactgagaatattcaaataacaattttaaaatataggtaattctggagagctaagagttctttcttaacagtgctgtaggaagatacaatctttgtattattttgttgagttgctagcaaactttattttatataggacctattaaattgtccttctaagatgaatgacatttaaaacatgaactattatttatacttaaaacttgaggccagacacggtacctcaagcctgtaatctcagcactttgggaggccaaggtgggtggattgcttgagcacaggaattcgaaaccagcccagacaacatgacaaaaccccttctctacaaaaaatacaaaaattagctgggtgtggtggtgtgtacctgtagtcccagctacttgggaagctgaggtgggaggatccttgacttgggaggtgtatgttgcattgagctgagatggcaccactgcactgcagcctgggtgacagagccagatcctgtcccaaaacaggaaaaaaacaaaaaccaaaaacttgataacttttgcttctctgcatgtgtatgtttgtgtgtttaactattagcttttcttagccatatactccggggcatgatgttattagaactttgaatgtatatatgtaacaatatctaggctgggtgcggtggctcatgcctgtaatcccagcactttgggaggccgaggygggcggatcacaaggtcaggagtttgagaacagcctgaccaacatggtgaaacctcatctctactaaaaatacaaaaattagtcaggcgtggtggcacgcacctgtaatcccagctactcaggaggctgaggcaggagaatcgcttgaacccgggaggcagaggttgcagtgagccaaggtcacaccactgcacrccagcctgggtgacagagtgagattccatctcaaaaaaaacaaacaatattttatgatgtccagaaaaaagcatttttttaaaactccaactaattttaagtaatgttttcatttttcaggatataagatacaaatgaatgcaagaaaaactataatgtcattttaaaatcctttttgtgatactagttttgggggcctaaacttagaaacaatgttttcagaagaagtagtcagttgtataaacattgatttgtgattttttaaatgatatagatatactctttagaatacctgcatcaggaataagaactatttcctcatggaaatcaaatgcataaactaaaatggaaggaacctgagtaaagttacctctataaaagccatcttggttatattaaaaatatgagrttatatttgttaatgctctaccttttgtatatctttttgttttcagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaactttatttttacagaattgagtaaaaaatacctattgtgttgccatgagtaaattggtgtgtctatgtataatgtaaagattgctctagctggctgaggggaaaatgtgaggtcattattactattttctttactctttgaacattttcacaccaaagaaaaggtggaaaaaaagtgcaagatagtgttggtgggaggaacacttattccctgtgtctcatgtcttcatgtggagggcttccactggttaatgttcctagcctctctctccacccactggagggagagtgactccctgattatgtttggagaataactaggcacccatgtcctatatacccttctagttccttccctgtggactctggctgccagcagaaagaatgtgtcctggcagttctctgccttgtgcagagaatagcctgtagccagcccagccagtgacagagtgagtccagaggtgtaatatattggcaggccaacctggctgcagccctgaagctaccttcccgttttattagcaatagttactttgacctccatcgacctnactccagctctctcagttccaaacttggataggaaggagggtgttctttactggatccctcaaaaattcatggaacctatatgaccagattctgattaccttcacttccttaccaccagctttactcacctagtttattgcaatttcagtagcctctcaattgccttccttgtttccactcctgtcccccttacagaacatatcaccaagtgtgattcttttaaatgaaagtcaggtattgacatacgtctgctcaaaaccctctccctatcatggagtaaatgctgaagtccttcacatgcataacctgctcatgacctcaagagctcctctcctttctccccttgctcactccatcccaacccacacctgcctcctggccactccccaaacctgccaggcacattcccaaccaaggacttttgcacttagttctctctgcctgtaaacatcttcccccagacagccacatagcttgttctctcccttcctgtcacctcagtgaggagcgttgcctcatcaccccactgaaatttacaatccctcactgctcccaaccctgacatattcctcattctctttagcacttaccaccagcaagctcaaaaagcgtaccatagatggaaattatggccaaaatgacttctagtaacagatgtactagattatcctgcttccacaggcttttccgtctcctaaagcctgaaaatactctgagctctcacatggcacattgttgcattcttgctgtattcggaatatgtgtgcttgtccctgctctgaaggcacttctgtgcatgtgtccaccacagagccctatgtgctaaggtcctttcgtgtctgacaaggaagggatgtggttttagtcaagtaaccaaagcagaggagtcaagatttttgctttccttttatccccttcttggccttgtacaaactttggatattatgggcaagctgatcactgcatcttaaaaatggaactacataaagctctggtcagaggaaatgaaatatggggacaaacttgtgaaataatggcaagataggagctttagcttaaaaagatgtttaggaaagatagatatgactacggtcaaactatgaatcgtatggataaggaagactagttgaccataaatgtagtctgtcaaataataataatatttgaccaaatttcagatctgtctgtcttcataaaagacagttacctagaacagcgtttgaaacataataaatgtttcctgaattaaactaaaagtataatccttactttgggacttcttttttttttttttttttgagatggagtctcagtctgttgtccaggctggagtgcaatggcaggatctcagctcactgcaaccaccacccccagggttcaagcaattttcctgcctcagcctcctgagtagctggggttacaggcatgcgccacctcgctcggctgatttttgtatttttagtagagacggggtttcaccatgttggtcaggctggtcttgaactcctgacctcatgatctgcccgcctcggcctctcaaagtgttgggattacagggggacttttattatagatggaaattatagaggatttaaggaaaatatttaatctaccaacttcactatctatcatatatcttatttactgcatctaaaaccaatttaacagtggtataatatctatctatttgctgtagcttaagattcattaaataaaatatctgtatttttggcaaatattcacacaaaccaagaaaaaaagattcccagatttttatttctggaactgtacaccaggtattaaagtacaacaaatacaaaataatgctcaaaaaaatcagtgtttatgtacaaatattaaaatcaatgcaatagcaacttcctcttgaacatctgatactgaaacttgttctgattgtcactaatttatctcatactcacagggtacttatttcaaactgggacaattggaatcactggtcatctaagaggaatattaatatctaccatatttaacaataaaactaatagtttcctccatttagtgaaaaaattaggaactttttaaaaaacatagtaacgtcaatattttataaattatttcaatttccatttgtagacaatgtgctttgaaactctgggcaaacaatctccttggtggtcaggtttatttgttagtttacattcaaagttgaaatattcactagagactttggttaaattaaatagtatcactatgctctattagatctgatgttctcaaatatttatgagcctcaacattttaaaaattaaaaaggaaatgattgcacaattctttgatctaattgtacaaattttagtattttttaaacagtattctacatccttcaagtaaattcagcagctgaccatgacaagaggaaaactaaacatttaaaaagctagcatgaaaaagatgaagtacaactaacaaatgtattgctataatcacagcaccagttacacttctaaatgaatccactgtccttttcaaattccctgtacataaaagatatatcagccaacactgcaactgctcaccatgaatttttggtttgttcataagaaaataatggggcaaaggaaaaaaaaacaaaaagaatttatcacagtttgttataagaattgtgcttaacacttgataataaaggcattattgtttcttcacatgattgcaaatccggttgttttcttgcttccaaatgcaattcttttaataaacagtaacaaattctctgttaagatgtttaaactgagagaaaaaaaaaacccagtaaatccagcttttaaaagaaaattcaataaatagctattttacatggataaagtcatagtggtacaatttatgaatgtcacatcaagcatgcacaaaaatggtattatacatggcagaagtagtcagaaaatattgaattagatctaaaaagatatgaagaatttacacttatatacaaaaatcttgcaaattattgcctcattttaacaaggaattaaaagtaaacattaccagctagttagcactctctaagaggctaaaatcagattgacatttaaaaatctattaaactagctggaatttatttttctctcataccattttctggattttggtcaaaaatctttatttaaataactaaagtgtccattcaacttgctgataatcaaaactttagataagaaacactgtttccatcttatatcaagaccccagcaatgcatagataaactgaatatattactgcatcagctactgagaatgggcatgttcatttaagtgcaactggtattagcattcagtcatctttgtgtaaattatttatacagaccagccactgtaaacccagagtgaaaattaaggttataacaatggaagattatggccagtatcttactaaattatagaaagtgtactgatttttaataaaagaaataaggttcaaagtttagcacaacaacacagcaataagaagctgacaacttggataaaaatacaagaaagtaacacagagcccaggctacccattatttactgtgtgcatacaggaatgctatacttcagatgtataaattagagactgattttaagttattaatttaactactttttgtccactgtgctaaactaaattttatactaatgtgctactgcgtaaacacttcaaagcaatcttcattaaaatgctgcaaagaaaaacaagaatacacatcatccaaaactaaggatgtcattgcagttcacagtttgtataataaataccctccctttcaatcactactaagatcactacatcctatctactcatcagcacaaccttgaagcaacttatacttacaaatattagcaatgcagccaaacatttgttttttgcaaagcaactagtaaaaatcaagaattttaattaagacggtgcaaacaacataattctctattttaacagtactacaaaagcaaagattacatcctaatactgtattacatattgtttgattcaccttataacttaaaaatgcatgtttatagcacaaaaatggccaaagtttaggacaatggcttctcattcacaatatttggaataaaaataaaactgagtttgagatacatctgaacatctatcaatttttaaaacttaaaagtggtaatgtaccattctatttcagataggaactcacattattcttgccaactgttcaagcttaacaaaaaagcttaaatatacttcaaggttctactgcattaggtataaaatctagaagtccctctaaatattaacactttgaactgcagtgctacaaacaacttaaaagatgtcccaaaatgtaaaccattgagtggcaanatcctaggctttgtagactgtgcctctgcaagtcgactgcctcaggataaactaaattatcaatgactggtatgatttttaagattacaatcttgacaatggtggacaaaaccccatctgagtaccacatcttcaaatgccaaaactgtagccaataaatgaagttacacagaaatctcctggcagtaacatgaccaattctgtgtaaggtagccctggtctagaattttgaaacaggatccaagcaagcgtcttcattatttgcacacagttccttgtgctggcttccataaagatggacttgctgttttgtaaactgaagtgctctagttgaataacatgagagaagtttccatttttaaaaaatccttgcatgtttgtgcagtttaaagaaacctacccctgcttttattaagaaaataaaaccaaaaaaatgctacattgagcagggatcgggatcggtacctgtaaacattgttattccactgcatccattacggcaaaaggaatttacacaaaaasaggccacaccattcagttcagaacatctgtgctggttttgagctggtggcctctgtctacaggttttaaaattgggagtgagggcagtggggaacacaaaagaatagaaaaagaagggagtggggaagaggtattgggagatgaggaagagagaagcagagcttaaagctgcaccacagagttcaatcttagttcccaactctgctgatcatagttcatttccacatttatggattgaaaaatgaaaatactcttgataaatcaagatatagttctatacatactgacatcactgatgtcatagtgagaaaggttcaaacttccagtgaaagactatgcaaacctgatagctcccctcaagtttactggtgctgcacacgcagttccgggatcctcactcaggtcactcagagtgtagggccgcgtgctgatgcagagcatgggcactgatgaaaccattggtctcgttggcagagagactgccaaagtcagccacagaaacagccy

SEQ ID NO: 10756 - DNA, 51995 bp, Homo sapiens
cttggtcatggcgttctgggctgtcatgcgtgtggctgtgttcaggtctttcacagtcatcaccgacagcaccgggtcccagatgcgaaactggacatcggctcccacggacagcacagccccgtccttagaggccagctgttgggggaggccatgagagagagacactcaaggggctgggggtgcagggaggtcaggcccactggggccacccagcttgaaccacctgcttggcagctagctcctcaagggcaaatggtgtcaccaagtatgtagggttaggtgtatgaagcaaggatgtcctcctagcttccatcaattttctggtctcttcttcccccttcccccctcagatggtgactcacaggctgaggtcctggcaccacagtacattctggacaggcccccagttcctctgtcaaggcagctgagaagcccctcaccttgcagggagggacgttgaaggctcgtgtcctcagatccaccctctgaaaggagtcaatgaagggyaagagcagaaccatgccaggtccctggggggtgcggatccggcccaggcggaacacaatcatccgctcgtaggtgggcacaatctgtccacaatggcaagggaaagagttgaaagtggtcagcctaggctggccaatgctgtctgcctaggtcccttcctcacttctctcctcctcacctgggtcacagttaggtatccctagcactgtttccagatgagaaaaccaaggctcagggaagctaagtgactgctcaaaaattgcatagccctaagtgaaatagtgaagatttgaatgcagttctgaataactccaaaggccatgtgtcttaactactgcactgtattgacttgatccttagagaaacttttcatctctgtggtctgaagttagacatgactcataccaggaaactgtctgtccttggattagttaggagaaaaggctsggctgccctaacagcacccccggggaaagggctttgtcaactttaggtccctggacctcctagagaagtagtgatgtccaaattgagaaatgaaggcccagagaggcaaagaaacctgttcaaggtcacatggcatttgtttctgtggcagttttagaactaggatataaggccatttaaggacccccttgcagaccacaccaaacccagaggttttctagagagggactgttgcctagggctacacaaagggcaaggcctccttgggcttccaccttcccccagctttcacgtgcgatgctgaactatagctccatggttcatccttttcccactgtaccaccccttatggaaaatgaggcctgaattcctattatgcactaccagctgggctaagttgggtgttttcatttctaatttattctaacccaaagagaagataatttggcaaagacatctgcgtgtaccttaaagccagtgtccagatcccaggacttaggagtttgggacttgcttctaccccctactggctcccagtatgactttagacaagcccaagccttagtttcctcccctgaccaatgtgaatgaatggttcttgcctagcccattacacaaaggggtaataatatttagggaaaggggacagaggataggcaaatttattcatcaatgccaaagctctcagtgtggcccaaccaccctgggggctgacccagccagccttaccttcagggcaaaccagccagaaatggggaaggtgaccaacagcagcaagaaccccaggaaactgatgaggccatgacagaggcaggagggccagctctggggtacatctgcaggtgagagcagaggtggtcaactggacctgcacgacagctgccaagcggagtgaacttgggcaagtgtaccttacgcccaccttcccctcgagaggctccttccttctcagggctctcaatctggctccttgcctaatattcccgtatctttgggcagctgcaagttagggtctgttccctcctcccatacatcaacactcatttgtcccaagtccaacaaccctcacaaggccttattctctgctaggcaacagccattcaatctcagaatccagtccgcgtgatgatgctctcctcactggactgagtaggggtcaatcctctcgtttaatttatattgcctacccatacctggcatggagccaggagcacctgggcatctgtaaacatgcactgaatactgctggcaaaacacattcctcctataccatcagccccagaagtgtgctttccaggagtccttatgaagatgatgccttagcctacagggataaatcataaatagcttatcaacgggagccacagatgaggaattagattattattttctattccacacccaactttaatgccttaatgaccattaaaaaatgcctatttcacgagatggcgccactgcactccagcctgggggacagagcgagactccatctcaaaaaaacaacaaacaacaaaaaacaaaaacaaaaaaaaaccctgcctatttcaattcaagaaaattgttaggggtcggggtcaggggcagggctagaaagatgaggcttatccaagccaaatgtcctggcccctggagattcaggagcccaagttgggagcaaagccgagacagctccagaatctgggatgaggttatttgccgctttcctcccaaccctggacaggaagcagtcgggagccctgctccattcttccaggaagccctgccctctgggctaagccccagagcactgaggctccactttgtgcctggctctgatccaccaggcctctcaagagacttctggatagggagagctttcaggacaggaaggccagggagggatcaaatccaaggttaggcggttaggctgaacagcgtgggatctggcctgtaggccaaaggagccacagaagactttgagggcaagacagaagcagggcagatccaacaggcagctgaggacctgtcattttggcctgcacatccaggagatgcctagttcccgggcttctagaggtgccccctagggcgaaaattcttccatttccctgcagcaggtgcctttagggtgctggtggcctcctctgcctagacctcggtttcttctatgcgaaatagaaacctgaaacgtcttcccaggcctaaagggctgataagagccgaggacaaatgtggtgaggtgaggttttggaagataggagcaacgctggctggctctggggccaaagccccatgaccctagggagggcggatcggcgctagcaccaggcgccgggtccagccccctctccacatcgtatccctttctcagtcccccctcgtagggtgcgacggcaccgggccggccgactcctcggaggcagagattcgggcctgggggttgccggccggtcccccccggstccgccgtgccaggcggccactcaccggcccctgtccccacgccgccccgctccggggacaagcagcccttctgcgagcccagaaagccgaagctcgactgctggaagcggtcaaaatcacccaggggcagcgcccggtacccagacctgccgagcatggcttttgacaggagacacgccccgcgcctccgcgcggcgccctccctggccagtgggccctacgcggccccgccctcctggctgctgcttccggcttcacccgcgcggccacccgcggcggcgcgggcgcaggaagaggaggccggccggggcccgcttccgccgtcgcatggctccccctgcgctgggaggaccgaactgcagcccagggctactgggtgtgatcggcgttcctcggaccccgctggggtcatcgcctcctcccctcttctcctactcagccctagaaaagctggaggggaagctgggcacggtggctcactcctataatccatcaatttgggagactcaggcaggaggatcgcttgaggccaggaattcaggaccatcctgagcaacatagtgagagcccatctctacaaaaaatttttaaaaattagcctggcgtgggatgcctgcctgtggtcccagccacttgggaggctgaggcgggaggatctcttgagtccaggagtttgaggctgcagtgagctatgatcgtgccactgcactgcagtcggagcgagagagcaagatctcatcagggtttacaggaagccaatcttctccaggatcaaggacatgctatatcagccttctcagcactccttctctcacactggaggcaggacatgccatatctggactttgggtttctctgggacatagtctgcaaattattcctctttgtgaacccacagcccagcaagcagggactggcatagggcaggtctcaatacttatttgttaagtaatggcctggccaggtcaccgtgatcaaggtggagtaggaaggcctgaactttggcacaaaaagaaagaagtttcacatgcagacttcggggagcatgggagtgtaaggaagaaggggatagcacagagctacatgagggcaggggccccagagcaccacagaggtgaggccctcagtcctgcaggtccagaaagagcatgccccttgatccaggtacctggaattaacttgcctctccagggcttgagaaaacctgaatgcaactcgtgaatttcctttgagaagtgttaacttccaacaggactttggggtagtctgggagcaggctatcttccaaagcaagcaaagaaatgaataaagcttccccagctctgcctcctcagccaatcgcctctggcctccgaagccccatcctgccatagcccacttccaggtcccttgtgcagatggctgcccaccatatttggctttcatggactgattctctaaaggcctgggagtactgaccaggctggagggaagggcaggctcctgaggccttacagtccctaggaagttgcgtatctgcccaacccctgctctccaccctgcagactgtaaggtttacaagagccaggccctatcatcatcctttctagtctgtttctaagttggaacagagtacggaatgggtacacaggagccagcacagtggttgcgatggtttaagtttgaagccggggcgctgacccagtgaggtcacctggaactgtgcccctttccccttaccagctgggagtctgacatgcttttccattggcgaagacctagctggctctcccctcaccctcttcatacccgctctccagctctccccctccctcctgcccccaccacctcagatccaccagcctttccagctgtcactcaaggcatcatcctgctccctcacctccagtcactggcttcccaggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctyccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagaggtactattgggttaggggatgatggggttaagctttgttggtttgctgtggtggggagaggcgggaagagagggtctaacggaggatttggtcaagtaccctagagagtgacacaaagcgggaagtccagacaccagggtcctgaccgtctcgggtggggcagggaagggagggtaggatagagtagaaaagaggacacggaggagttggggcggcctcgctgggctgcggtttctccactgagcagttgggcaaggtgagaagggtcagtggcctccgggcctgggcccttccgcccaccctcgagccctgcctcaactttgcctcagatgcaggacttcagattagggaggatggaggtagtacccctgttgcgctggcctggagccaggggcatgtcccaggcacggcaaaactaaaaccaacttcccagatccgaggtgagaaactggctcagactgaagaggtatctttgccaaggcctcccagctcatgtggtttctgcttaaggaagcctccccaacgaacccttctcttgccacacctttcctgcccacctcccacctcccccgacaaaggaactacttgggtttcttgctctgctgcctttcaggcccttttactccccttcatgaaagtacagaggacaccgtattacagtaacttttataaacattattacaactaagaataacattacttaacaatactaggtaacatttatgagcacttcaaatgtgccaggtactgtattaagcactttggtttttttttgttgttgtttgtttgttttgctttgttttttgtttgtttgtttatctgtttgtttttgagacggagtctcacactgtcgcccaggctggagtgcaatggtgcgatctcggctcactgcaacctcctccttccgggttcacgccattctcctgcctcagcctcccgagtagctgggattacaggccacgccaccatacctggctattttttatatttttagtagagatggggtttcactatgttggccagattggtctctaactcctgacctcgtgatccacccacctcggcctcccaaagtgctgggattacaggcatgagccaccatgcccggcctgtttttgtattttacaaaatgtggtaaaatatacctaatggataagttcctatgttaaccatttataagtgtaccattcagtggcattaagtagattcacaatattgtgtaaccatcaccaccatctatttccagaactttttcattactccagaaactctgtactctttaaaccataggggagggaaagatggcttgcctccacccttctagtttccttggctgggctatgaattaaatagcctatgaattaaatagtcataaaatagattaccagcggaaaacccatatttaattacatatgtatactcaggagtcccacaatatatgagactcaaagaaaggtcagatgattgaagcctgtataacatcctgagctacggaaaagagcttggagcttctgggtgatggtgataacacaagttatgggagggtgaggagaggagctgtttggtgaatagaggttgtcttgctatgtagattaaaagttcttagataataaaagttgtctggagcagccctcttttaatatagatcattttactaatgtagattttcttttaagatataaatgcctttcttttttacaaaaggagagcttttcagagctattcctgtatcagcagtttctcagaataaccagcttaaaatatgccaaagaagtatatttcaagagcctcctgcagtcatactttgaagtggtgtgtcctgagccccagtaatgcaatagctcctcattttctccttcccctagcccttggtaacttctaatctaccttctgtccctatgaacttacttattctagatatttcatgtaagtggaattgttaccagtagaggatcttgactgcaaattgttcaggttcttggcattttgaacaaagaattggacaaaatgtacagcaaagcaaggaaagagtgaagcaatgaaagcagagatttattgaaaatgaaagtacaccccacagggtgggagcggctagagcagggctcaaggaccccagttacagaatcttctgggttccaaataccccctagaggtttcccattggccacttggtgttcaccccattggttgcagaaagcaaccaaccagacgtactttcaattttccatctgccctgcaggaaatggggtgatttgcaaagagagtagcctctcttccttttgttactgaggcatggagagttgcggttttcctttcgatttagttctaggaagtcagagggaatcggccttaggttccctgcctccagaccctattctcctgcctcagaatcatacagtrtttgaccttttgtgactggcttatttcacttagcataatgtcattgaggtctatctatgttgtagcatgtatcagaatttcatttctttctaacgctgagtaatattccattatatgtgtagaccacattttgtttatctattcatctgttgatggatacttggattgtttctacattttgtctattgtgaatagtgttgctgtggacattgttgtacaagtatctgtttgggccttgtttttacatcttttggttatatatctaagagtggaatttctgggtcatattgttgttccatgcttacctctttaatgaacccccaaactgtgcattaagcactttatatgaggttggtacttagtgtatctaccttccaaactgagttccttgaaggcagaatgtatcctacacctcttatatctcagagcctattactgtgggtgatgagaagtagatgctcaataaatggtgcagtgagagctggagggcctgaataaatgggggtattggggtgctgataagccagggttttgcatcatccaatgactggctggaatggaatatgaggtcctactccagggtccagctgtaagggtggttggccggtaggtgggggcttttgggacttctccaggcctcacctgcctctctggtcccccagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcamccctacgctgaccaggtgagtaggccggcacagggtggggtggtgcatccaagtaccaggtagagggcgagaggagcaaagatccaaagagtcacacagctgaggacaaggagcttctggggccttgcaactctaaatgtggtctgcagatatgcagtgtccgtgttgatgaccacaatttatgctgccaktccccacgcaggtggatagtaagtttccartttcctcctgtaataaataatgctgcagaatcatctttgcatctttatccagtaacttctttaggataaatttttagaagtgccactgctgggtgtagggggacgggaattctacatttgatacatgttaccaaactgccctttagaatttagtggaattttccgagagcactgacacggaatctcagtaaggctggattctaggatcagagacargtagktagtttctgtctgaaaagttgaaaccattaacaccaggcagcgctatctgagaatgtctgtatggggaaaaaaaatcacatccagttgtaattatttttattaaacagattttaactcagttttttaataggtaatacattcgtacagttcacgaacaaaatttgtaaagaggagagagagagtgcaatcttctgtccatgcccaactgcctaattcccaccacttctccctcttcccatccacaggtagccattgttactagttttgaatgtttcttctgagagtttctttacgaatatatatgcaggtaggagcaatcttatcaggtcctattttccctcttttagccaaaaaggtagcataactatgtgaacttttcaccattagcaatagattgttcatagaaggcgcttcttggttcttagagatccacttgcaaaatgaaagcatttttcgctggtttttgacaactcagaactatatatggctaaaccacatatttgctraactacatatctgctaaactgactgtgatttgtttcctgctttaggataaacttcccacactatcagaataagctttcccctccgactcctcaacagctggtatcaccacgtttcttagcttattgtaaaggttgagtggctttccacttgtttattggccattgtgtttctgcatttgcgagtggcctgtttaggtcctttgcctgttgttgttgttgtttcckttgaggaattaagggactaattaaagaattcaggaacaaattcctcgaaagaaaaaaatgtatgcatttcttttgctcttacaatttatgcagttttaaaacttacatatttattggattttgattgaaattgcaataaattaggagaaattggctttatctctggttctatcttttggatttaaaaaattttttttaattttttttttttttttttgagatggagtctcgctgtgtcacccaggctggagtgcagtggcgcgatctcggctcactgcaacctccacctcccgggttcacgccattttcctgcctcagcctcccaagtagctgcgattacaggtgcacatcatcatgcctggctaattttttggcatttttagtagagacagggtttcactataatggtcaggctggtctcctgacctcaggtgatccacctgcctcggcctcccaaagttctgggattacaggcatgagccaccatgcccagccttatactaatttcttaatgaatttgtaagctttcatgttttgaacgtgataatgcagccatcccacgggatccatgggagtctgtttcaaattcatagatgctcaagtctctgatataaaatggcatagtatttgtatataacctctacacatcctcctgtatactttattttttattttatttttattttttgagacggggtcttgctctgtcgcccaggctggagtgcagtgctgcactcgtggctcactgcagcctcaatctcttgggttcaaacaatcctcccacctcagccaccagattatacaggactgcaggtgtgcaccaccacactcagctaatttttaaattttttgtagagacagggttkcacgacattgcccagactggtcttgagaactcttgggctcaggcagcaaccctccctaggcctctcaaagtgctgggattacaggtgtgagccactgtacccatcccctcctgtatactttaagtcatctctagattacttataatgcctaatacaatgtaaatgctatgtaaagagttgttttactatatttttgaatttgtatatttttttattgtggtacttttttaattgattttttttcgcctgaatatttttgatccaagatttgttgaatccacgggtgcgtaacctgcagatactgagggccaactgtacatataaattgtttagcgtagtgcctggcacatattaaatactcagtgaatgttaaaattctattataatttctctgctctagaacaatttgaagaatataagaaatttaggcttataaaagttttttgaaaaaccatcttggaactggtgccttttttatagtagatttttgggaacttttcccatttttgccatggcattaatctgttttggctcttgtgtcagatttttggaagattttccagttcatcctgagttatctttcattatttaaaaatctcctatatgcctgtaactataccccctttttttatttctgatgttgtatatttgtggtttagcagtcttttcaaagtactgtacttttagtctttccttagattgcttactgattttaatgttttccttctttctgtttgatcattttatttttgtcattttcttccttctaacttttgtcattattcattttctagcttcttgaacttataattcatttatttgcaatctttattgtttaataataataacttttttttttttgagaatctccctctgtcacccaggctggagtgcagtggtagatcttggctcactgcaacctgtgcctcctgggttcaagtgattctcctgcctcagcctccccagtagctgagactacaggtgcccaccaccatgcctggctaattttttttatttttagtagagacggggtttccccatgttgaccaggctggtctcgaactcctggcctcaagtgatccacccgcctcagtctcccaaagttctgggattacaggcgtgagctacaatgccctgcctaataataactcttttaaggcataagttctctgtatatggttttggctgtatgccataactttgataacttcattagtgttctcatagtcaatcatttctcaaatttcatttcagtcttttcttaaaaaggttctcttgcttaaggtcaagagttcgagatcagcctgggcaacatagcaagacctcatctttacaaaaaataaaaaaaattagccaggcatggtcggtggtacatgcttgtagtcccagttatttgggaggttgaggcaggagggttgcttgaacctaagaatttgagcctgcagtgagctgtgatggtgccacttcactccaaccagagcatcagaaccggaccctgactcgaaaaaaaaaaaaaagaaatttttttctcttgaaaagttttagagaatagtgttttctaaaattttcaagtggttttgatgtttggtttcttgttctgtcacccaggctggaatgtgatggtgcgatttcatacttgttaatttctgcactatggccagtttatacagtttgtatgagttctacatctaagactatattgagattttcttagcggcctaggatattccttggactcacatattcctagcaataatccttagagttgaaaagttgtatttgttgtacacacatatatatacatacacaaatatatgtatataatatatatgtgtatatatgcatatatctatatgtatatatccatatatatgtaagttctagtgcttgtgtgtgtgtgtgtatctccacgctattgaaactttctacctttctttcttttctttttttttttttttttttgatggagtcttgctctgtcatccaggttggagtgcagtggcatgatctcggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcccaaagtgctgggattacaggcgtgagccaacatgtctggccgaaactttctacctttccttccattctgtttcaccagttctctaaatgataattacagagtggtaacttccccatcaaaacatatatataggccagatgtggtggcttccacctgtaatcccaacactttgggaggccaaggccggtggatattttgagcccaggagtttgaggccagcctgggcaatatggtgaaaccccgtctctacaaaaaaatacaaaattagctggacatggtggcacatgcctctcgtcccagctattcgggaggtggaggtattcctcagagaggatcacctgagcctgtccgttcaaggatgcagtgagccatgatcacgccactgcactccagcctgggtgacacaatgagactctgtcttaaaaaaagaaaaaaagtgggccaggcgcagtggctcacgcttgtaatcccagcactttgggaggctgaggcaggcggatcatgaggtcaggagttcaataccagcctcaccaacatggtgaaacctcgtctctattaaaaatacaaaaattagccgggcgtggtggcgggcgcctgtaatcccagctactcgggaggctgaggtaggagaattgcttgaaactggaaggcggaggttgcagtgagctgagattgtgccactgcactccagcctgggcaacaagagtgaaactccatctcagaaaaaaaaagtgtatacacacaccaacacacacatacatgcacactctagaacctatctcatctatcaccacaaagagtagaatataactattcttccagagaaaataaaacatttagcacacttttatagtttttcttcttccctcttccttctcactttcagatttagttgaaataatgtgaacttttagttccagattactaccaaattgttaatttttttttcttttgtaaacatcctttctgaacaggtattaagcttcatggtcatattacaacgcacttgttagccataccttatactttaattggtttcattgctcatgataagttttcctatagcttttcttctcctttcttgaattatttaaggtgattaattttccatttggcaggaatactccatcaagtaattaaaaaaattattccagagtttactttctgagaccttaagtgtctttacttgtatgtccttcttttgctgtcacatgtgagggaaagttgagctaggtgtaaaattctgaggtcataatcacagtgctttcacctcagaatatataaaccttgcttcataaatttctagtctctggtgttgtagatgagaagtccactaatggtctattttttctctgtgagtaatctgtttttgtttgttaaggatctttatttatttttatttattttactttttagagatggggtctcactctgtcacccaggttggaatgcagtggtgcaatcagagttcactgcagcctcaaactcctgggctcaagcaatcctcccaccttgacctcccaagtagccaggactacaggcacctgccaccgtgcctggctaataaatatagttggatggttttcatttgtttatttgtttgtttagagataagttcttgctctgttgcccaggctggtgtgcagtggtgtgatcatagctcactgtaacctcgaactcctagactcaagaggtctgctagccttagtctctgagtagctaggactataggtgcctgccaccatgcctggctaatttttaaaattttatgtagagatagggtctcactatattgcccaggctggtctaaactcctggcttcaagtgatcctcctgccttagccgcccaaagcactgggattacaggcttgagcccatgcccagcctgctaaagatctttatataattttttcttttttcaataatcttctatcgccattgttgatctgaaaaactcaagtctttcttcagctcttcatctcagggaaattgtattctgctttttaattttttttttttttttgagatagagtattgctcttggaatatagtggcatgatcttggctcattgcaacctttgcctcccaggctcaagcagttctcatgcctcagcctcccaagtagctggaactacaggaatgcgccactacacctggctaatttttgcattttctttttagtagacacaaggttttgccatattggccaggctggtcttgaattcctggcctcaagtgatctgcccgccttggcctcccaaagtgctgggattataggygtgagccactgtgcctggccatactttttaatatactgatagcccttcatttgtttattttattttttatttttattttttgagacagggtctcactctcacccaggctggagtgcaatggcacgatctcggctcactgcaacctccacctcctgggttcaagtgattttcctgcctcagcctcccgagtagctgggactacaggtgcgcaccaccatgcccagctaatttttgtattattagtagagacggcgtttcaccatattggccaggctggtctcgaactcctgacctcgtgatccacccgcctcagcctcccaaagtgctgggattacaggtgtgagccactgcacccggcccatttgtttatttttaaaatttttactactgttgttatatggatattggaactccaagaacatattttacatcttttaaattttttccccattaattctgttgctttgcttttttccccgagattctcagagagctcctcgaattgtttttctaactcgccagctcatcttttcgccgctgactccattcttctatctgctacccctgtagagttgttgtgggtttttttccccccagcaatctttttttttttaattgccaaaagagcttaatgctctcaggatgctttttcttggcagcctgctcttgttttctcattgtagtgtgttcttaagtctccctgaaaaacacagttggcatttacagaggtgtatgtttcctacacgatccccttttcaatgggtacttgctcagtttggctgctgattctcttcataggtcctgcggtctgtgctatctgctcccatgtaaaagttgacatctagattgttcagtgtttgtagctagcgtgggctggcagcaattgtgtaaagcacaatttataccccacattcaatccctgcagtggaacagggccgctccccacgagccccagatggtgtcagcttgtaagtagtcccacctctgctgtgggggtcagaggtggatttctctccattagggatagaaaaaaaccttttgtctgtacccattttagatgtccagctaggtccctgtaaattagactaacaagatatagattaacacgagaaaagcaggctgggtgctgcggctcacacctgtaggcccagcgctttgggaggctgaggtgggtggatcacctgaggtcaggagttcgagaccagcctggccaacatggtgaaaccccatctctaccaaaaatataaaaattcgccaggcatggtgtcacacacctgtaatcccagctactcaggaggctgaggcaggagaattgcatgaaccctggaggtggaggctgcagtgagctgagatcacaccactgcactccagcctgggcgacagagcgagactccgtctcaaaaaaaaaaaaaaaaaaaagaaagaaaaacaggagctttttagcatgtgcatctagcatgggtatcacatctagcatgggaattgtgcatatacctgggagtatccagagatgagtaactcaaagcgttggttagaacttcagcttacatagcatcttaatgaaagagaaagaaatgtttagagaagtggcagggtaaaagaaaggggttttaggcttgcaaaggtggcaaactgttggaagttgtgtttctgttttgcattgctagaaggaatacctgaggctgggtaatttgtaaagaaaagaggtttatttggctcatgttctgcatgctgtacaatcatggcaccagaaacctgcttggcctcaggtgaggctgcaggtaggttttactcatggcggaaggtgaagggggaacaggcgtgtcgcatggcaagaggggagcaagagagagagaaggaggaagcaagagaaggagatgccaggcgcctttaaataaccagctctcccttgaactaccaaagagaggatttactctttaccacgggatggccccaagccattcataaggcatccaccctcatgacccaaacacctcccactagaccccaccttcaacattggaggtcacacttcaacatgagatttggtaaatatatgggaactctaatggagtaaggtttgtttgtgcgggcctacttggtgccagctttccatcttcgtggctgtaaaacttccctgagagaggagatttatggtagttcttgtttctcagaagtttctgttttttgtcataagagcaaagagcgtaagagtcaaaagagtttctgtttttagtcatgagagaagctcttagaaggctcctttctgcgtctgttggttttcatttgcctgcagctcaaaacaatcatatgccaaagtggcatattttggagtggcatatttttatcccttatgtcaggtacaatgggcagggaaggttcagccagcaagagggcaggattcctgttccttgagcacggtgcatggccttaacaaacctgaaaaatcatgtgctcccactcccatttcacattgtttcacaatttaccagtggttactggacaaactcaacttattttttctgcacaaaacttcaatgccataaataagagctcacaactttcctctggtcacaagtcagttagcagccacctcgctctttgaccctgggctgatttagagctcacactggggagcagccccagaggtggctttaaacctgggactcggggtgtctgccctggggtggctgccctggggtggctgccctggggccattggtatttgctccacatgcctgtggagtccattttttcatgttcatgtcacacctactgtgttgcatgttctttactagggggtggggtagaaatatgaatggacatagcccctccttgagatcacagcctggtaaacagatcagccattaacaattgaggcggcagggttccgtgcagaaggctgcatgactttgctgtctattgtgactgcgttttgatagttacctttgtcacactgtcttctgtattatgtttgccctcagcaacatgtcgtatctggcacagggctgacatcctgtttgtgctcagtcatttgtggaaggaagaagtcaggcaggcacaaaggtggctgagctcagaaaaggccacttaccctgctgggatcagctggggaaggtggcttccaagaggccatcacacttagtgtgatgtataaggaaatagaaaggccacagacaggagggactgcacgtgcaaggaaggggcactagtgagtttgcagcatctcaggaactgcaatagaaggttgatgtgagggcaggcactagaagggtgagttggggtcagatgtggcaggcttggaaggagtcaggactctatgctacaatttccagaacactcagtgttctcagctttctcctttgtcatgccttcataccacctaatcttctcaccagtgactatcctctggaagacaatgggaatgggaccctgtggagggctctgttgaaaacccattgatggggccgggcgtggtggctcacgcctgtaatcccagcactttgggaggctgaggtgggcagatcacgaggtcaggagattgagaccatcctggctaacatggtgaaaccccgtctctactaaaaatacaaaaaaattagccgggcgtggtggcgggtgcctgtagtcccagctacttaggaggctgaggcgggagaatggcgtgaacccaggaggcggagcttgcagtgagccaagattgcgccgatgcactccagcctgggtgacagagcgagactgtgtctcaaaaaaaaaaaaaaaaaggaaaacccattgatgggcattgaggagtggtgggatgatcagagcctctctctgcactctggtactttgacaagagtgggcaagtttgggaacagggatatcagtatttctttggctgcatacttatttatatttcaccccattccacggagaatttgaggggatttatcaccagatgtgggatacttatccaatagaaactgaagcaaagaatctggacaagggaaagggagcctcatgagtacactaggtcttaggtccaggtgggggtgaggcctgcaagaatgcagagatggaggggtgtggagacggctgtggtcccacactgccagcacttgcctgaccagacattctcaggagtgcttccacccaagcatggtgtgggtctagggctgcaggtggagctaagtcctgtctgcgtctgggtgtcagatcctaaaatttgctggatggagttggggaattaatccagctgaaagagcttgaattatcattgaatggaggaaacaaaaggcctattaatcaagtttaagaggtgtgattgaaggattggcacctatccctgcttggtgctctcttggtgccctctgtgaagttagcagtaaattgcattttattggggattgatattattgggattgcttcctggcctgcaaggagcattacatgggcagaagaaaggctgctgccaggagttgggcaacatgatgaaagatgtggacaataaatgacccatttcctagtttttctatgaacttatcttgaaggtagatttatagaataatatgtggataaaaggggttttcctcctggtctcctttgatgttttggagaaagaagcaaggactttatttatttatttgtttatttttgagacagtgtcttgatctgacacccaggctggagtgcagtggcacagtcatggcttgcggcagcctcaacctcccaggttcaagtgatcctcctaccttagccttcctagtttgtagagacgagttttcaccatgttgcccaggttggtctcgaactcctgggctccacccacctcggcttctcaaagtgctgtgattacaggcttgagccaccacgcccagccagaagcagggaatttaaagcagcgcaagccaagatcaggattagggctggtgctccggtctcacttctcctgaaggccaatcgcctctactttctgcagctatgggagtgggctttgctattcagggatggaggcctgggacattttagaacaatttgggttttttagttttgtttttttgagacagggacttgctctgtcacccaggctggagtgcagtgtgcgattatagcttactgaagccttgacctcccaggcccaagttatcctcccacctcagacccccaagtataatagctgggactacagacatgcaccaccatgcccagctaattttttttttttttttttttttttttttgtagagatgggctttcattatgttccctaggctggtctcaaactactgagctcaggcaatccacctgcctgggcctcccgaagtgctgggattacaggcgtgaaccactgtgcccagcctttagaacaatttttaacaagacttgaaattaacaagcttttggcatagtggtgcacgcctgtagtcccagctactagggagactgaggtgggaggatcacttgagcctcagaggttgaggctgcagtaagccataatcatgccattgcactccagcctgggcaacagagcgaggccttgtctctaaaaaaaaaaaaaaaaaaagaaattaacaagcttttctcattgattgctaactgataaaattaaaaactattaatagaaccaccgccagccagccagacagccattgagcaatcacttattgagcatttatttcatgactggtgttatgatagctattgccagatgaaaaagaatgcctgccttcgaagcttgaatttgtggagagtttcagcctatggataagttgcatgtgtgtgcagacttgtactctatggcaagaacccagaggtcccagaagatacgttcagatcaagtgctgtggcagttttcagaagggaaaacttgtatttatgtgggagggtcagggaaaccctgatattttagcatttgggctacaccttgaagggtttatttgtctctataagttgcatctaaaacaaactgtataaattagtgagtttttttagttagtagcttaagcaaaagctggattgatggctgatgtaagtgcataggggtcaagctggcctctgacctgaccaattagatattcagattgtgtcaccaggaggtactttctctgtatttcttgtgacctggctttcttccaagactggtccattcacagaagggtttactcctcatgggtgccagatgattgcaacagctccagaggttacaccctcagccccaaattcaaggggaaaagagtgtgaatctctcccagcattccaagctaaatctcagtgtgtctttgattgggtcaggttcctctccctgcaagggtggctcaggctaggggggttctcagattagcgtaagcctgagtcatatgctcccccaaagctcatggactgagaacaggaatgtgtggctacctaaaggcaaagtccagtttcatattggtacaagaagaaagaagaatgtgcctttaatacatcttagaaaaaatgtccaatagccaccgtaaatgaaagcaaagaagaaaaaaacactccaggtatatggaaggcagtggaacagaaactgaagtgcaggggacaggtttgaagccagcctcaagtgaaacaccctgaccccttggtgcctgggtaaactcttttcaatagaaagccatccttttccaaccaggttagggaatgggctgttcaggctgcatgcaacctttcctgttgacaaagtggagaactatcctgccatttgagatgtttttcctgtgctattctcctaactcccacaccctcctgtaagattatcaggaagagagaactgttccctttgtacaaacaaggcgagaggccagagagttaacaggagcttcccaaaagggagagcttgccagagccggggccagaacaggatgcagggtttcctgattgcagaatgggtgcccctttcctactcctgctggactctacattcaggcagcccacagctaatgactgcactgagttgcaaaaagaattctaaaagttgtttcttaagaatttagagtgtatcttaagtaagcatgcaatttaagcaatgttgaacttaattttcccttttacagaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcartggcgcaatcttggctcactgcaacctccgcctcccgggttcaagcaattctcctgcctcagcatcccgagtagctgggattacaagtgcctgccaccactcctggctaatttttgtgtttttagtagagacagggtttcaccatcttggccaggctggtcttgaactcctgacctcgtgatccacccaccttggcctcccaaagtgctgggattacaggcgtgagccaccgtgcctggccatttttttgtatttttagtagagatggggtttcgccatgttggccaggctggtctcgaactcctgatttcaggtaatccacccacctgggcctcccaaagtgcttggattacaggcagaagccaccatgcccagccccatatcgtttgtttttaatgaaatgcttctattttacatggtagtaactgagtctctgcaatgaaagatcaagatggttggcttccatccttctagttttggttccatgtcaataggactgtaaggttcaccactggtctttttactttaacatcacttttcccaagttttgtattttgattgagctcttaattggatagatattatcaawaagcaatyttttttttccargaaggacttttttgttctgaattccttgagtctcttggtgttgagaatgtctttgggttactctgatacttgaataatatctcggctgggtataatattcttaggtcacaatcactttcacaattttgtagacactgctgcattatcttccagcatcaaatgttcattaggacagctctggggtcaaactgacttgctttttctgtctttatgcctaaagatattttttattcttgaaatttattaatttaaccaagctgtcttggtgtttaacattttgtatcaaattattctggaacctagcatgctccttcaatctaaaaattatctttatttcaattgcttaaattacttctcctccatcttccttttcttccttctcattttcttctttttcttgctctattactaataatatcacaatttgtaatttattaactttaggtgtgttcagtttagtaatataacagtactactaccatttagggtgggggaacttatttacttaatgacttaatgaatgagtaacaaagattagaaccaccatatacattcacttgatacatatttttataaaagtgcttgagaatatcagaattatttatgtcacacaaggagttactgcctgttttctgtgtcaccagattctattaacatttaatgattacctttactctttgaattttgaattttgtaacaaattcctgctgtggcatattttgcaatttggttatgttctgccaaagctgtaacagtaggtgaggtgtttcaaatttggcatgactgaatagaagagctgcccgttctcaccatatgttactcaactcatatattgctatgttatttttaccttactcatcaaattatcttttctcttatacatggctttaattaattgattattttaggtatttccatctctggacatttcatgtactgaaaatagatcagatttaaataaaatagctttataatcagtatttatgtgataaactctgtcttatttcttgcaacatttaccggcatgtaaatccaaattgaatattggttaatgttcagcaatattcaatactatataattgtagtgtattgttatgaaagtcaatgaatttccccccatgatgtactttgttccaaaatttgaatctcctttaataacatataacacataagttgcttaaaaaatttctcactgctgacactatttggattgtacttatgacaggcatactggccatcacctcagcatatgaggataaccatattttagaaataccatgctggtggcactggggagagctgattggagctggagagaccagaggcagggaggcctcttaggacatcgtgctcaaggagataagcaataattgaggcaagaacagaggcagtagcagtgggaactgctgggacaggtttaggagccagcattctgccttaatcatctttayacccttgccgcatgcctagacctagttggtacttagtaattttgggggggtttttttgagatagagtctcsctctgcctcccaggcagkagcgcagtggcgtgatctcagctcactgcaacctctgcctcctgggttcaagtgattctcttaccctcagcctcccaagtagctgggattacaggtgcccgccaccacactcagctaatttttgtatttttattagagacgggaggccgaggcgggtggatcacaaggtcaggagttcgagacgagcctgaccaatatggtgaaaacctgtctctactaaaaatacaaaaattagctgggcgtggtggcgggtgcctatagtcccagctactcagtaggctgaggcaggagaatcacttgaacctggaaggcagaggttgcagtgagccgagatcatgccactgcactctagcctgggtggcagagcgagactctttctcaaaaaaaagaaaaaaaagaaatcattgaagccatagaggacagggaggcatccaggagtggccattgaatggtggtgccattccccaccataaagatggcaggagaaacagggaacccacgtggcagtgtacccactgcctgttgaatgagtgacatgatccaggggaacactgcccactatggatacaccagccatatgccttgggagcaggtacctgtgtagaaaagagtggagaagaaaaagcacaaactttctcctccccattcctgggtgtggcaccagcatcagacaggagttcaaacagtgcttcctttcaccgctttccttgctgcttttctattctggtatcttcttctccaagacctcaggctttcccctctccaacactaccttctcagccaataaatcactggaggggaggtccataggaataatgcattcactctcttcaaatatcccaggctctagaattacccatctcctctcctggtttcagaaatcttgttttttcaatggtgagatagcaggaaactgatctggtaaaatgcattcatactactgtataaatgattgatggatccttttaactgtagttacttraatttccaaaagagctctcttttaccactctaccaaagtgaaagtgccaagttgctgcatggaaatgggacaggtagaggagagtttttggtcaccattcaggcaagccaggtggtaccagctctccttcactggtcctatttcataacatttttgcttcttgcattttagagctaccagtttcctagaacagcagaagtagcatgctcccctggcccaaccaacaggtgcggctatagtggcctatctgtactggggaggggacaccccaaatctgacattgacaggttcacccaacagcagggatgtcctgtgccatgtgtaataccccctcttctttcatagctccagaatgtccaatgactacatagcactgtgctgagtccttcacatacaccagcctgtctttgtgcttgtaacagtctataagggaagcattattactcccattctacaggtggggaaattaagactcagagagaaaaggtaatttgctcaaggccttgtagctagaaatttggaagagctaacacataccactcttggcatagcagtttagacatggacagctttaggatggggagactgagaacccaggaaacacgttgaggcttctattaaaatacactactcggccaggcgagatggctcatgcctgtaatcccagcaatttgggaggccgaggtgggcagatcacgaggtcaagagattgagaccatcctggccaacatggtgaaaccctgtgtctactaaaaatacaaaaattagctgagtgtggtggtgcacgcctatagtcccagctactcaggaggctgaggcaggagaatcacttgaacccaggaggcagaggttgcaatgagccgagattgccccactttactccagcctggtaacagagcgagactccatctcaaaataaataaataaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctttgttgtaatacctagatgggatgttctttgagtgttccccattgcttcctatttaaagtccaaactcctttacttagaattgattatagaaagtttaggaaaatctaaataggtgaaaaggagggatgagagaaagaggaaactactatcactctagaccttttcctttcctttttgctatctctgtgatcatctaaaacaaaatgaacaacatttagtgttgtataacttgcttttcttataaatagtcatgaagatctttcaaaaaaatatacagttttgaattttttaggcagtggcatcttttttttttttttttttttttgagatggagtctcgctctgtcgcccaggctggagtgcagtggtgcgatcttggctcactgcaagctccgcctcccgggttcatgccattctcctgcctcagcctcctgagtagctgggactacaggcacatgccaccatgcccggccaattttttgtattttttagtagagatggggtttcaccatgttagccaggatggtctcgatctcctgacctcgtgatccacccacctcggcctcccaaagtgctgggattacaggcatgagccgccgcgcccggccgggcagtggcatctattgattgtatggtttcttttatttcttcagtaattatagtgtctttactatggtgagagtaaatagtccactgtgttttctccttcgagatgtaattttacacatttaactttgtgattcattggaagcatatatgggtatgaaacaagaagcaaggctctaacttcattcctgccccctaccctcctccctagccaatttctctgattccaattgttgaaaacccctttaatgtccatcagtttgggctgctggctgggcgcagtggctcacgcctgtgatcccagcactttgggaggcaggggctggcggatcacctgaggtcaggagatcgagaccagcctggccggcatggtgaaaccctgtctctactgaaaatacaaaagaattagccaggtgtggtggcgtacacctgtagttccggctgcttgggaggctgaggcaggagaatcgcttgaacccaggaggtggaggttgcaatgagttgagatcacgccactgcactccagcttgggtgacacagtgagactctctcaaaaagaaaaaagagaaaaagatgggttgctttctttgttatataaaatattacatttctatagatgccagggactacatcaggcctatctggtctgttctactgatccttctcttgactcttgaactagtaccatattctcttaataatggcatttctataatgtgttatcccttccttacactgattcctcaaacatttcttagcagctggtcatagtggcttaggcctgaaatcgcagcacttttggggccaaggtggaaggatgacttgagcccaggagtttgagaccagcctgggcaaaatgttgagactctgtctctataaaattaaaaatttttttcttagctattttatctgtttgttccttcatatgaaatttagaaacctagccaggcgtggtggctcacgcctgtaatcccagcacttctgggaggctgaggcgggtggatcacctgagatcaggagttcgagaccagcctggccaacatggtgaaaccccagctctactaaaaatacaaaaaaaattagccaggcatggtggctcacacctgtagtcccagctacttgggaggctgaggcacaagaatcacttgaaccagggaggcagagattgcagtgagccaagattgtgccactgcactccagcctgggcaacagagtgagactcagtctcaaaaaaaaaaaaaaagaaaagaaaaagaaagaaaagaaatttagaatactttggttaagtttcaaaaataatttaaattgccttaaacctgtttattaactcaaggagaattaataatcttataatatttagtcttatctcttagtaggtttttgtcattttctaggtattttgtaccttcttttttttaatttaaaaaaagttttttagagatggagttcttgctgagttgcccaggctggcctggaactcctgggtgtaggcaatcctctcaccacagcctccctagtagctgggactataggcacacaatcatggctttgtagaattttttaaatagctgctgtgaatgggaagatggatttttttcccatatttcttctcatttgctttgctaagatagaattatgctatttttctttcttaattattatgtaatctagccactttggtgagcaatttcttattaagttagtggtgtttttgcttattgttttgagtattccagaagcaaatagatgttatttcgcctttctgaagatacggttaagtctgggttcttgtcacggagcccttctgggcagtttcccacttcacctctgcctcctccaaagtgccargcacgcagcaggtactcagtgagtgtcctctgaatgaaggtaaaggaaccgcttggctaaggtcattcctggccctgggtggcagccctttgattcaggatctgcacctcagtcttaccagagggctgggggcttttagacccaggtgtctgattcaggctagccacctcacagacacttgccrcccatytccatctrgagggaaagcaggggccagtcaccctagggagaccccattcaggacaaaagaagcttagaaaaaggacccagcggaggctatggccatccagaacgtcttgctctctatccagccaggctgcctgaggcgtgcccttccaggcttggaaccctgtctccaaggaaggggatccaacatcagacacagcccctctccccaagtgtccargatccaaagggggaaaataacaactgtttcttattctcttccctttattcctataccctatagaattgcccacatttattagtattctgttttttaatttcaaaaaaaggaatacattcatacattcacaaggctcaaacataatctaaaaaggtatgcagtgaatgtcttactctaccctcattccacccatcccatagccacttttattaatttgcatgtccttttaatatttatttattcaaatacaatmaactatgaagatattcttatttttccccattcttacacaaaaggtagcatctgatacacacatttctgcaccttgatttctaacttaaaatatatatcataataatacaaatagttagcatttattgaacactcattgtatgccagtcatttttcaaacttttatccatatattaactcatttaatccttccagtactcctattattaacctcatttctccatggagaattttccttatcagtatataaagagcttcctcaatggcttacagctacatagtattccgttgtatgggtggatcataatttatgtaactaattgccttgtgagggacacgtgggtggcttctaattctttgctattgtggactgtgctgcagtgaatatattgtatggatatcatcttgttatgtgtagagatagagctgcagagcagatccaaagaaagaggattgctgggttaaatgcatttgtaattctgatgggtattgccaaattgccttctgtagagttattagttcttttcataattgcttagtatttctaattaaacgtagcattgatgagcactatgtatcagtctggctggctagtaggctctctgttggtggttccagaacaagttgatctcagtgtagtcccagatgagaccctttcttctggcctcaggtgggctgacttattccttttttttttttttttttttgagatggagtcttgctctgttggccaggctggagtacagtggtgcaattttggcttactgtaacctccacctcctgggttcaagcagttctcccacctcagcctcccaagtagctgggattacaggcgcacaccaccaagacttattcttatcactgccggtgagagtaaattacagcaatatttctggggaactaacagtattttccctggtaatatttgaagaagcagccttgtaatggttaagaacatggactctaagctggactgcctgggtttttatattttctttcgctgctgtaacaaactaccacaaatttaggggcttaaaacaatgtaaatgtattctgttatggttctggaggtaagaagtctgaaacaggtctcactgaggtatataaaggtgtcagcaggctttgctcctttgggaggctctcagggagaacgttttcttgcctttcccagcttctagaggctgcccacattccttggtgcatggcccctttctgtcttcaaagccggcaacatcacaacattcccacctctgcattcatcacatcacatctcctctcattctcctgcctccctgccctttcctttgaaaggattcacgtgattacgttgaacccacccagataatctagaataatctctttatctcaaagtccttaattgaataacacctgcaaagacccttttgccatagtaaggtgacatattcacaggtctcaggaatttgcacgtggacatctttagaggccactattctgctactacagtttgcatctagactctaccacttactaatcgtgtgatcttgaacaaattattttgcctcttgcaccagttttctcatccttaaaatggggataataatggtatctattccactggattgtcaggaggattgaatgagtaaatatttgccaatgcttataatagtatctgagacacaataaatgctatggaagtatctgctagctaaaatatattaaccaggccaggcacggtggctcacacctgtaatcccagcactttgggaggctggggcgggtggatcacctgaggtcgggagttcaagaccagcctgaccaacatggagaaacctcgtctctactaaaaatacaaaattagccggggtggtggcgcatgcttgtaatcccagctactcgggaggctgaggcaggagaattgcttgaacccgggaggcagaggttgcggtaagctgagatggtgccattgcactccagcctgggcaacaagagcgaaactccatctcaaaaaaaaaataaccaaataaaaatattaaaatacaaacactttgatctagcaggcctatatttataatctatttcataggaacaaaagcttccatgattaggctatataacttggatattactaaagtgttgtccatattggcaccaaaagaaaaaaaaaaggaaaggaaaacgaaagaaagaaaatgcacaaacaggaaattacctgaatgccagcaaaacgacagtgattgaatcaattgtggcccatctgggatataccagagctattaaagagaatacatctgatctgtgcctatgcacctagaggaatgctctgagtgaaagttcgttgagaggaggaagttcaaagtaattatatgacttgatttatttctttcttttttttgagacggagttttgctcttgttgcccaggctggagtgcaatggcaccatctgggctcaccgcagcctccgcctcccgggttcaagcaattctcctgcctcagcctcctgagtagctgggattacaggcatgcggcaacacacccggctaattttgtatttttagtagagacggggtttctccatgttggtcaggcaggtcttgaactcccgacctcaggtgatcctcccgccccggcctcccaaagtgctgggattacaggcgtgagccaccgcgcccggccgatttctttctttctttttttttgaacaaacatcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaaggtaagcacgcacgccaccttcctgggcggcctgtgcctctgctgcaccctagggaaggcgagtcagaagagatcatctccatttgacagaaaagaaaactgggtgtttattcagtctttgggggttggtaaggtcttaggttccagggcacaggataagggggagatgaggccctgacaaagggctgcagccacccagaggggacacattttactaatttacaagactctgtggattgacctagcgatgactcatggggaacacgtgaaagttgaaaaactgcaaagctgagaatcagacccagtatcattttggcgccagagggaccaagcacttcaggaggttctcttaagccaccggtgtctcggaacagagaagtcaattgggacctggggttacggtagaagggggctaagaaaacctcctggggatggttggatgcttacccaaaaccatacagtggctcagtggaggagatcccttgtctgcaggatgacctgctgtctgccaacctttgcgcgccctgcctagtgttggacgcttgagaggtaaggagacacagactagtttctgatctcaaggagccagagccacttcacgtagctggagaatgagacagtgctcagctctgcaatccaaatccgggagatgtagcagctgtgtattagctggaacaggggggctttcaaaataaggggtagggggagtgtgccagagagtctccaggagtctttgactaaatctccaagctggaatgtgagctctgagcagctagtataggatgcccttactgggaaaggggagggaggctatggaatctgaaggcacctgggtagggtgccagtgacaaagagcttatttacttctcctggagctggacatgggtcatgaaggataatcttagagggcctggacctgtgccttctccacctaggtagtgaatgtcacccatattaaggaaatgaccccacagagtttacacagcttgccttgggtgttataactgggcaatagcagagagaagggttattttattctgaagcataagagatttagatttaataaaaaccaggctgcagataaggaagatcatggagctctcactatatgtagagagtcagtgagccggtagtgatggctttatgattgcgcacacttagccttgctgttggctcagagatggagagaggtacacttggggtttggagccaaaagcaagcactctaatgccacctccttttcccttctggctgggttcctgcccactgcattcgagagagctctccttccagcygcccctccagggagttgtccagtgctttgggatgccctggaaaataggtatcctggaaaagcaacagggacctcctctctatcactgtcccaggtcaggatgtcccttaccagcatgtccttgacctgcctgtgaccttctttgtgttctacagatgcagctgtatccaagaaagccagcccagaggctgccagcactcccagggaccctattgacgttgacctggtgagatgggtttgaggtctgaasgggtggtggtggggcccagcaggtcaggcaggttgtgagtcctgctgtccctgtgtgtgcagggagagcrtctgagtgagggacagcaagtggctggactggaaatttcagtgagaggaagtaaaggaagacattaaagaagggttggctggctagctggctctgactctaggctcctaaatgccaaagttgctcttgatgggccatgagccaggttcagtgggggttagatgtggggtagacagtcggccacagatcagggctgctgcagagggaattccagcattagatggcatattagtgccttccagccatgagaaactatggttgtcagatgtatggttagatatagggtcagcagtcctgagggatgtgcagatgtcctctcccctcctacaccctacccccaatgtgkgagccttctcttggagtcagaataggtgggccttcccctgctctttccccacagatggttcttggaaaggaacggggaatggtgccaggagtcagatttcgatcccagttgcccgggttctgctggtgtgattccagggccaccatacatgtaacaaagcagactgtctcagggttcaaggtatccatgtcccatctaatgctggcattccttctgcagcacccctgacctgtggctgtccagctttcatgtacacatctccagggacaggaagcttgctcattctagaggcagctgctcccaactctggactgctctgacttagaaagtgcttttccgagtggaaatgcagtggtgtccctttgacttgccccctttggcattcacaagtatggctcctttccaccagaataagcatcctcggtttcttcctggacttggcatctggtctcttccctagcctagtcactcaggtttgcatgcgcctagcctatcaaggatctggcccaggactggccagtccttcatggacagcaggtcttctggtggtgggtaggggcctagcttttgccatggcatgacccataggagagagagagtgctgtaggttgaggcaatcaggagaggcttcctggaagagacaggacttaagagtctcagagttttagagccaggcaagagcatggagtctaaccccctttttttcacagaggacgaagctaagacccagaaaggatgtgacttacccaaggctacacacagcaaattaggggcaagattaaaagctgactctgttttttgtttgtttgtttgtttgttttttagatgaaggctcgctctgttgttcaggctggagtgtagtggcgtgatctcggctcactgcaccctccgcttccggggttcaagccattctcctgcctcagcctcccgagtagctgggactacaggcgcgcaccactacgcctggctaatttttgtattttttagtagagacggggtttcatcatattggccaggctggtcttgaactcctgacctcatgatctgcccgcctcggcctcccaaagtgctgggattacaggcgtgagccactgtgcccagcctaaaagctgactcttaactgccttgggtactgcattcctatatacacaacctcaagtaaaaagaggaattttttaatatatgtgtgcataatacaatcacatagtcagaaataaaaacatagaaagtgatcaatagtgtcttactcccactttagcccccagttcttatgcccatataactatcttttaaaaatttcttttgagacagtcttgctctgtcacccaggctggagtgcagtgacacaatctcggctcactgcaacttctgccccctgggttcaagcgattctcatgcctcagcctcctgagtagctgggattataggcacgcactaccacacccagctaattttttgcatttttaggagagatggggttttgctatgttagccaggatactctcaaactcctggcctcaagtgatctacccacctcagcctcccaaaagtgctgggattacaggcataagccaccgtgccccacctcttttttaaattcttatatatccttccagaatgtatgtaattacaagcaaatattattatagatatttgccttttgcattctgtgtttcacaaaggtaggataataccagatacacatggtatcataccagaattcttatcctatcaataggtagagagcttcccgatacctttttgcagctgcataatggaccattaaatggatatggcaggctttatttagccagttccttgttgctgcatatttaggttgttttgctattacaaacaatgctacaatgcatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagrtgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttytcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcrgggagttcgtggcctgtctggaaagagggtcttttacataccagcagtttgcagagccagacacagaacgatagagcaggaccttttaaactcctttttcaaaaaaaaaaaaaaaatgtttaattttggtaaaatacacataatataaaatmcatcatcttaaccatttcaaaatgttcagttcagtgtacactaagtgtacagktctttagcattgagtacattcacactgctgtgcagccattaccaccacccgttccagaaggattttcatcttcccaagctggaactctgttcctgttaaacagtcactccccatgctgcctccctcagccctggtgacccttgtctactttctgtctctatgattttcaatactctaggtacctcctataagtggaatcacacagtatttgtccttttgtgactggccactttcacttagtgcagtgttctcagggttcatccatgtagcatgtgtcagaatttcctttctttttaaagctgaataataatatcccattatgtgtatatgccacattttgttgatccattcgtctgttggacacttggcttgtttccattttttggctattgtgaatctgctactatgaacacgggtgtacagatatctccttgagaccttgctttcaattattttgcatgtttactcagaagtgggatcgctggatcatatggtaattctatttttaattttttttttgaggaatcaccatgctgttttccattttttattgcaccatttgacatttccaccagcaccgtgtaaaagtttcgacttctctacagcctcaccaacatttgttatattgtctctctctctttttttcttaaataatagtcattctaatgtgtgtgaggtgggttaaactcttttttgaccactatcctctattgaaaaaaaatatatattatatcttaacttatagtatatacatatgcacacacatactgtagctaaaggagttttataaaataggctgggtccagtggctcacgcctgtaatcctagcactttgggaggcggaggcaagtggatcacctgaggtcaggagttcaagaccagcctgaccaacatgatgaaacctcgtctcttctaaaaatacaaacattagccgggcgtgatggcaggcacctgtaatcccagctactcaggaggctgaggcaggagaatcacttgaacctgggaggcagaggttgcagtgagccaagattatgccactatactccagccggagcaacaagagcaagactctgcctcaaaaaaaaagaaagaaagaaaaaagttttacagaataaattatgattgttacatgggatgtactctgataatttctattctatactattatttttgacataaaaatgttggtcatgccccactaaattgctttcatggttggatccactaatgggtcacaagctgcagtttgaaaaccactggccttaagagtgactagactttcctagaggcctggcagagacagatcctgggagataatctgttctctctccttcccaagacaggctcacactctctaatccagagaggtcatcctccttctttttaaagatttggagaaaaagaaaggaaggaaggaagggaggagggaaggaggtcaatccatcatggccaatggtgtggagcccatgagaaggacccaccgcggggttctggtacctggcacacccaggagccagcactgtgctggggccatccctgcctyaactcacatgcccagcagcctctgtcgggagcctccttgcccagccccagcttgcctgggtggttctcagaaggcccacacaggagggacagagcttgtccctgtgaggaaggtgtatccctgccactcactcattttcaataatcggtccagtggacgcttaaagttcacaaaagagagaaagatggtggggagggacataaaagactcatcaagtaaagaaaatgaagagcacgccggggcaggaagaggcctccatttcaagacactggatttggccaggtgtggtggctcatgcctgtaatcccagcactttgggaggccgaggcgggtggatcacctgaggtcaggagtttgagaccagcctggccaacatggtgaaaccccatctctactaaaaatacaaaaattagctgggcgtggggctgtgcgcctgtaatcctagctacttaggaggctaaggcaggagaatcgcttgaacccagaaagccgaggttgcagtgagccgagatagtgccactgcactccatctcctgggcaacagagcaagactctgtctcaaaacaaacaaacaaacaaacgaacaaaaaacactagattcaagtcaggccaggggtcccgaggtatgtgaccttgggaaatcacttcacctctctctgcctccgtttccttctctgaagattggcaataatcatagtacggtacctactttttttttaactataatttttatggcgataaaattcatataaaattcaccattttaactcttgaagtgtgcaatttagtggtatttattacattcataatattttttaaattttttaattttttttctttgcagctccagctcaaatgattaaatttttttctttttaattttcagagatgaggtcttgctatgttgcctaggtgggaggctcaggtgattctcccacctcagcctcctgtactttcataatcttgcacagccattgccacctatctagccccagaatatttttatgcccccaaaaggaaaccccttacccatgaagcagtcagtcccatttccccctcccccatctcctggcaaccaccaatctgctttctgtgtctatggatttatccattctgggcattgcatgtaaataggatcatacaatgtgtattttgtgtctggtttctttttttaaaaaaatttattattattattagtgtttgagacagagtctcactctgtgccccaggctggagtgcagtgacacaatctcggctcactgcaatgtctgcctcagggctcaagcgattctcatgcctcagcctcccaagtagctgggactacaggtgtgcaccaccacgtctggctggtgtctttcatttaatgtaatacattcaaggctcatccatgttgtacatctcagtcctcattgctttttatggctgaataatattccatcacgtggctataccacattttgtttattcagtcatcagttgatgcacatttagtttgttttaccttttggctattgtgagtagtgctgctctgaacattcacgtgcaagcttttgtttaaccgtctgttttcccttcttttgggtgcacacctggggtagaattgctaggtcatatggtaattctacatttaattttttaagaaactgcctctatttcattttgagataggtacatgaagcacttagcactgtgcctggcacagagtagtaataagaacaatatttatcatcatcaatgacattttctaagtgccaggtattttatattttacttgtattaacacatttcatccacattaccatatgaggtagatgttattattcccactttatagagggggactgaggcctgaggagttttaagcaattcatccaacttgtgtagtagctgacccaggtagagttaaggctgagagggcagaggcaaggtcccagggaggccagtttcagctcaatgggaggattttctcactgttaaaggagctgctttcgccagtagtgagcactttgtccctggaggtgtgtgtctaagtagggctaattactgagcatgtcctgagttgggcagtgtgattcctggggtatcttccagccctgttaggacacacaacaaccaaagtggtccctgggctccagtaactcagagtcagaaggaggtgatgccagtcgcggtggctcgtgcctgtaatcccagcactctgggagactgaaacaggagaattgctcaagcccaggagttcaagaccagcgtgggcaacatagtgagaccctgtctctacaaaaaaatttttttaaaaaaaggaggtgatgtgatggagagtttggaggacttcttgtccccagtgagctcggagctttgagtcagggagcctggacctgtgacttggtgaggccccagggattaggccaaccacaggtctggggtacctggccctggggctgctgcctagtcatttctgactcaattttcccaactttgcagcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggtaaggttctccccagccccagccttccctcctgaaggcctgagttccaccaggaaagtgagctggcactggggtgggaatccaggccttcatcagatcagctctttgtgggaaagtgtttgctcracgccttctctgtgctctcccctgttcttggctgcatggtcagggagcttcccataagcatggcccactcccagcccagcaggggtgctgagacactcagggttgtcagaggccagcagagactggtggacagcagatagtaccagcttgggaaggcttcctgtctgaagagagacgtaatctgcgtggttgagagcagaggagaggggacagcaggagcaaaagggtggccacaagtccctggcagtcagggcaggctctgcccactcacccctgcaggcacctgacctggctctgtgactccctctatgcaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcrccggggaggcaggtagggaggtgggtagggcagtggcctgggtgctgcccgccagggtctgggcggtgcccctcttctgtattttggccccatccagaaagcccaaagccaacaggagtcccttattcccactgaataagatagggaaagttcacagtgtgcgtgggggtgagagtggacacagtttaccatgtgttttgccatgattgaggtgtggggagcctgacaggctaaaatgcacagttctatgagtcctttctcccaaacactactgtgcctttgcacagggcaggtctccacaagaagtttgttggctgatgcctagcatactcccagagagggcttgggcataccataacaggaaactggactccccatgaccttaactctgctctctcagtctacacccatcatttccccaagtgtttctgcaaaggccacctacctaagtatctcatttgtcagagttatcttctatgaacactgccaggcaggtagtcagttgggcaggagttgaggtcaacccagaggaatctggaacaagagagttctaaggatctgcttcacccagagtacagctttgttcctcattctgactgagccctagccttggtcacacactgagcactgactgatattccttacccacaaatgctattggtaatcgatgggttttgattaactaaatgaagcgtcttttaactctagacatcccagctcatggagctgagaatggggacagtgtgcttctttaggattgcagaaggttccagaccaggtagcagttgtcaggcctcctgtacagggggcaaaytctgaattctgggcagataacttaattgaatattcatagataaggcacagcaagaaattatggaaacccatttgtgaattactcaaatccaaatgcaaagcagagtcacattggcacacacagtggctgttcccgtccccctgcagggcatccrtttcccccagccgactggcctgcaaggattcccataggtgcacacccacacccctcccagcatgcatcctaggcagttcataatgcatctccccttccccgtttcagaggaacgcgttgtggtgatcagcagctcggaagactcagatgccgaaaactcggtgagtggcccagaagttcagcccaggactcctgcctccccccatttcaggtcccagggggcacagccacagcaggtgactctcagacttgccttgcgcctggggaattttccagtgaggcattgagtcccaagctgtgctgaggacagtctccaaatgacagctgcatgcctggaccaccccagccctcccactacaccagggccaggagctcttctgaaatgctgatagcatgtgtccagagccctgtctcttttctggaatgtccaagacctttgtctggagcttccttatgcattttctgtcctctaagtcctcagtgaggagggctggacaagaatccattccttggtttattacagccagtgggggccagtgaaggggtgtcaggccacagggcagctatataggggccaaacaagtgaggtttgactccatccatgtagaaagatatataaatccattccacagtgaaacaggtggcctcgtgggtagtgacccttctgtccctagaggtttattactagaggctggactatcacctgtccaggggaaaaggggatctgaatagagtgaaaggttggactgggtggcccctgaggtctcttccagccctcagtctgaggttctgtattggaaagtgcatggagcccatggagaccgccgagccacagtcctcgccagcccactcctcgccagcccactcctcgccagcccactcctcgccagtccagtctctgctgagagcacaaggagcctccagcctgccctgtggcacataccaccccccagcttggcctccccaccagcccgctgagcaggctgccacccccgatgctgagcctcacagcgagcctcctgatcaccaggagcgccctgccgtccaccgtgggatccgctacctgttgtacagagcacagagagccatccgccttcgccatgccctccgcttgcaccctcaattgcatcgggcccctattcggacttggtctccccatgtggtccaagccagcactcctgccatcacagggcccctcaaccatcctgccaatgcccaggaacatcctgcccagctgcaaaggggcatcagcccaccccaccggatacgaggggctgtgcgatcccgcagccgctccctccggggctcctcccatttatcccagtggctcaacaacttttttgccctccccttctcctccatggcttcccagcttgacatgtcttccgtggtgggggcaggggaargcagagcccagactcttggagcagktgttccccctggggactctgtcagaggctccatggaggcctctcaagtccaagtgcctctggaascctctccaattacattcccaccaccctgtgccccagaaaggccccccatcagcccagtcccaggcgcccgtcaagcaggcctctgagagtgctacccttctcttgtaaccttgcagccaacacccctgcccggcccctgagctgcctcctccagcccatgctcttacaggccctgcacagagtagcactcattaattcttggttaaggaatgaatcaacgaatgaatggctatgcatggacctctggkcagggagacctgggtcttctctggctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcacccttgcgaacccttattccacgaccatcgcgttctccgatggatccagctcctccctgcaggctgttctctcttccctatgctggaactcagttctcctctggggataccatgtcccctcttcctcccacactcatgggcatcagaggtgggaggtagggtcaaggccccctgcttcctggactgttccagccccttcctggccgtctggtaagatcctctgtccctctcagggtgggccccatgctccccagctcatcccagacacccacctgcccaccctcaytgagggcagacgtgagcattcacctcccagatttcttctccctgctcaggtcctgccttcctcctgagtgacttctatttccacccacctgcccgccactccttaacctctcaggggttgtcaccccattcccccagacagctgcctgccccgtggccgtgccctgcaccttgccatcaccgagcactgtcggtccctcagccggtcctctcagactctgaccgcagcctcctgttccttgagctctcagtcctaccttcgcctccctccagccccgcgcactccccatttcatcccatctttcatcagaattgcagctccctgcccagcagaaaatcctggaaggactcaggagcttgtcgcctctgtgctgccacctggagaccgagatctgcaggagaaaggcctgggaaaactatgagtggttgcctgtgactgctaagggctccttggtgctccgcccagcatgtccttttgctctgcagggcagcccccgcctgcctttcttcactgggcccttgtcccagcctcaccctcagctgatggcggcaccttctgctccagggagaaaacaggagctctccaatggcatagggacagttgacatcttgctatttacagatccccatcgcaccccttccctgccctcgttagggtggaagggatgtccacctgcctccaggactcaccctgtgtcctggccccagcccttgaccccctgggagcctcactcctcctcctcatctctcttgcatcttctaatgtatccactgccttctgaactaaacaccctgaatgaggtctttctcatctcagaaaactccacccacttctctctccagctgtcggctccccttcctctgctctccttgtttacacttcagccccctccttgccccttcttcaccccacctcctgcgcttccccgccagtaccagggtggcctctgtgcctctaggtgcagtgtcgcgtttagtcgttattattcttgaccggcgctgggcccggtctttcctggaaagatcgcctgctcggatgcagctctgggcactcctccctctcctctgcaggctctgttttttcttggttgtggtgctcctgcaggtttgctgctgggccctttcctcttttcagtctgtgtattctcccaggtgctctcagccacgcccctgacttcagttactgcccaggggtagctgatacccaacactcgcacctgcctgccagaccagcatggccagtgaccttccaacagctccgcatggatgcccataggtacctcaaactcagcaccttctcctcccgtctcactggctcgccccactctctgcccggttgcacaagccaagaccccatagccacccagggcaccccccttttgattattcctcacatccaaccagttattgagtcttgtctttctagggtgtaaattcctctgaaatctgggcacttctttccatcccataatcttggtaaaattaaagctaccactgaccctgggtagaggcagaagcctgggaaggaaaggtggagaacaggtttggagtgccaacagtgtccccagatgtcatggagaatcaagtagagggaccccagcaatattgggggtggggcggggagtatgtaatgctcagctatcagcaaggagtcattaggggctatacagtgaattaagggagggggtaaaagcacatttcaggtgatgatgaattaaatacctaggagctcacattagagagcaggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacacccagcaccaccactgcaaattcctactccccagcttggagggggtggggtgatattcccaaggtgatcccggctcccacctaacccatcctccccagctctgcagcttatatccagcyttgcagtgaggaaagttgcagaatactggtctgctacattactactttccaagtgtatcagggcatttaggaacccctcccttgagcttcacctgtgtcctagggattcagtgagagactgtttgtgyaagaaggagcgagaggcagcagggcatagtcatggggtggagcagtgagtcccccaggcctggttgtggagtacctggggtgaggactttgcttaaaaactgccagagtgggtcagcagtgcgcctgccctggggcccctgctttaggatccaaagtggaaaagataggtgttytcacccactcttgtgacagattactggctccggtgccttggtggcagcagcaacaggagggggccaaggtgagggggcagcctgtggcagaagtggcagtggtgacggcggaggaagggaggcctgtggggaatggctgatccaggggaggggccgtggcactggtgagtgtgcatctgagaaaatgaaacggaggtgctggccaagaggctggagctaggcagaagggcagcagaggccacaggctggccgagtttatggtccagttcactcmtaacatgtgcagtattcctggggtctttgaggctttgcaagagctggggttttgtgtctgcagaaagatagcaatgcatgtgtcttgccaaactgatcccagctgtagctgatgcttaagtgctcagaaagttcttcaggagcttgagggctcttgataagcatgaatgtcagatgttctgtatcttccagaggctggatgctgactatcagagtttggcttgtgtttggctgatgagcaaacctggaatgaatcagtgataaggacaattgttctcaagctggctgtacactggggagttttcccaactacagattcctaggtcctacgccctgagattctaatcgartcagtcttgggtgcagcctgggcctcagttttttcttaaagctatgaatgcctaaccaaagtcaagaaccactgaatcgggggattcattgcatgtctgtggtagaggaatgctgctcatttgtttatagatgtggcagtcttgaatgcaggtgacattttcataccagggtgtaataccgcagaggaggggagaggctggatcttccctgatgtacctcctggacttttggagtgtgattacaatgccaatccagccacttcctctgagcatgcttgggacgactgttagacctgctgtgttgagttagaatgcacttgacctgctcaggccgtgaaatctatgaggaaggggagtgagatggatgtagctcatgagccagattgcaggtgtatccaagttgcatgtatatcctgaaaaaatcctggctctcacgaggctcagcctgaacacagttttgcattcaaagaaacaatgtccattaaccaagtataataaagaaataaatcccagtatttacttgcatcttttgaaagaacattaaagggaatccagctcataaccccagcagcacttcttcagtccttcttccccttttctttggcgcctggcatctctcactgcatagcaaagctttcccccttgattcccggtcctcacacgcaggctcaaggctctgtttcccatcttctttcttctgtcccccttccttttctcttccaagcaaatctaagtcttttccagtgactgtccctctctatgctcccccgacacccagttatcctaatttgcggaataaggccaaggtgtggggcctgggggcagaatgggagagtctcccctagtgagcagggaggggagtatgttctgcaccaggccactatgtctgatggccctgctggcaaacctgagtctttcagaaagtcttgtttaaatgcgtcagcactccccagctgtgatgctggagtttaaggcggagcaggggagaattc

SEQ ID NO: 10757 - DNA, 36037 bp, Homo sapiens
  misc_feature (1)...(36037): n = A,T,C or G, or insertion/deletion polymorphism (see Tables 1-2)
gcaaaaacatttgtaggcatcattaatcttccctgcagtgtgcacacagaaagtcagattaacaaaattctataggagacaaacttaccttcaaaagacaaaagaaaaccactacattcttgaccaccacagggtataagcccttaattattaagagctactgcactgaggcaataactcctaagaaatcttaacatttcgccaggcaaggtggctcatcctgtaatcccagcactgggagagaatggcacacgtratcctagcctttaggaggccaaggcgggaggattgcttgagcccaggagtttaagaccagcctgggcaacagtgagatcccatctttacaaaaaattgaaaaatcatccaggcatggtggcctgtgcctgtaatcccagctgcttgggaggctgaggtgggagaatcacttgagcccaggaggctgaggctgcagtgagccaagatcgcactactgaactccagcctgggtgacagagcaagagactctgtctcaaaaaaaaaaaaaaaaaaagaaatcttaccgtctttagttcctatcaccattactgcagatttagaagcaatctacctgaatcagaaaatagagctcaaataagttgtgtggcttggtataatctgggaaaatcagtttcaaaagttacctgcccttgggatagaactttttgtcaacaccagttttcaaaaagtaccctagttatgaggccgttgctgggtaaactttatcccattccagcttcaaccagaggaacctgtacatcctaaagtttcacataagattacacttgaagaataggtttctccattaaaagacttgaaaactactggtcttcaggctccctacctgtttaatctgtcaagacattgccagcttaaatttcggacagttacataagtgtccctgttaacttcaaatggccctgacaggaatgctaaaacgtcagacattcaaatgggccaagctttatcaggattataaaactttcaaagctcaaaaacatgccatctctatgggaaacagtatcttggatttgatgttacaaaaggaacaagaaaatggtttctgaatggcagctttcagtttacaagtagtggcaaagtaaatgcttggatgttatgaggtagttgatctaaattgtgaggctttcttaaaggcactcctttgatctcatggagtgagagactagaaatctattcaacgtattaaaactcctctcccagcaaaataaaataaacaaaacatcctcctcctaatggctgaagttccatctagctgctatggccattttatggagcatggtgccatcttgtggccactctcaaaccacccattgttaatcaagtgcaattacagcatgttaagagtgaaaaggaaagctatttggagccatggtcacttgggatattttcaaatgttctcaaagaacatgacattttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtatcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggmtccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcwggcccagctcctgcagaatccrgctcaggtggaattcctggattggcagctttttggcttcactggcagtcaggtgtygcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaaccagtccctccagggagaacagagtctctcagcgaccctggcgtacccttctccaccgcttgtccccactccacccacaccaggtccccgcaggcccctgctccctctacacccgaaatcgcaggactacaagtccctcaatgccacttgcgccggaggcacttccttttccggttgtgctaggcgcctgctcctgycgacgtgttcttccggtggcggagcggcggattagccttcgcgggncaaaatggtgagagcgttgaggggagttccagacggagatgcgaggacccctcggggtctgacccacaccgcgcttatctcctcagacgccggagatccagagggctagacgctcctggaacctccggcttgggctgaagggtggggaagggggaagccccttgccatgaactccttaggtttctcagctcgcgatttctaagggcgagaggcgtggggcgaattttgaataccttccagtttgtatatctctgttatcggtggtgtgttatctttatttggaaagttcttctgccgaacccgtgcccatcctacaatgccctgggcaaatgtttattggtgaagcacttccaactctcaggcacttggccagactttcctaggagcgcccacagcctctgtacagatctctggccacgttccatggacttctttgttttcggccacgcctcctagtgaccaccgtctgacgcgcatctagctctgggatgatgtctattcatctttgtattctcagtgccaaacagagggcccgtaattggaagctcaataaatggcagtgattgtctttatcattttgggggaaggrggccgtgattgtttactgaattgaattccagtgtctcagaacaatgggggcagtttacttctctagagttgttatgttctggattttagaagcattggctgaccggtgacaatgaagttaacatttgtacagatctttacgtttacagccctctttcataaaagacattatctcatcatcttccctacagccttaggaaggaagcaaatacctgttgagcaaaatactccctgctaggcactagatgctttgattcatcatctttcttatttttcagttctgtgaaatagatattacagtcgctttactcagactcagattactcagaaccagaacttgaatgtcttgaccatagctcacaagattccataatagcataggtagtgaggaaaatactgaattagaaattgagggccaggcgcggtggttcactcctgtaatcccagcactttgggaggctgaggcgagcggatcaggaggtcagaagttcaagaccagcctggccagcaaggtgaaaccctgtctctcctaaaaatacaaaaaattagccgggcatggtggttcacgcctgtaatcccagctgctcgggaggctgaggcaggataatcacttgaacccagaaggcggagcttgcagtgagccgagttggcaccactgcactccaggcactccagcctgggcgatagagcaagactgtctggaaaaaaaaaaaaattgagcctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggtatgagaatctctagaacccgggaggcagaggttgcagtgagccgagatcgtgccactgccctccagcccgggcgacagagtgagacgccgtccaaaaaatgagactccgtcaaaaaaaaaagatattgagatctgggtaccaccagtcagtgacttatagcgggggttctcagcttggtgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacrttggattggggctgagagaaggtaaggaggagaggagggctngtgatgcccaggggcaggttatngccttatttcccaagttcaggtgagctcagtttgttctttggatttccaggacagtgagcaggggacctggctggagtggaggtggggaataggggtgctacagttggaaaggtggtataaggaagggtgcactcaggtgtcaggaggtctgagggctagtcccagctccggccctcatgagctgtgtgacctggggcaagtgacctaactcctctgggtctcattttcttcatggcagtggagcaccagagtccaaggcatctcttaggcccytctgcctggctgytctgagccagataggcctcccagaaggcattgagccaatgcttttctcctcagattgccgtgggctgggctctctgcactccacagtccacccyttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggtcagcagggtccttaaagctcttaccagcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccastaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcagtcctgtctggggcccattctgcaggggtggtgggtgctgggacmtacattgcttccccaatctcttccctttcccatttctcatctgcctttcacagttcctgctgctgatctacttaagggggatgagatttgtgtagcaccggtgttttgtcattggaatttaaggcttacctgtggatagggtctgggcctacccttttctattgtttctaggacaaacttctctgggaacccacatcggtccattctgccctaggccagtccctgccataaacatagccaccattctctgtgctggggcatcctcaccaggctcagcttctccccctaagaaggcttttctcctcagtggctacttttaatgcaggtgggcagcagcgggtgcgcaggaggggaaggtgtggccatgggagaggctgatgagtccactcctagccccaatatgaagctaagaggataaggggtatgaagcatccatttggccctctggttcaggcgctcagagattccaggcttctcaggaaraactttgaattccaattggccctagccttataggtgactcctctcccaccagaccaatcccaagaagagacaaggaggcaagctcagatacaaagcagtatttatacatttatttatatatgtatatttacttcagaagaaacgaacatttcggggacaggaagcaagcaggcccggggctgcttccctcactgcccacctcagagtcagagttggcacatgacaaataccaagctcagggagaagaactgggagttaactgggaagtagggggcgctctatgcacacgcaggcttctaagggtgcacggtatgggcaggaggatttgcactgggaggccctatgtacagcttgaagctagggggagattagcscagtgactacaggaacaaacgccaaaggagagagawgaagggwgggatgacctgctgnaccccagggcagggacagggccaagacactcacaccattgccagccgggcagctggcagcttccagcaggtggcccacttaccttccctgaagcccttttaccacaggcttaaggcaactttggtccaaggttgaccccctcaagcagcttggatccccagcctgtccccaactcctgcactgaggaacccctccccaggcttggaaacagagccagctgctaacggttttggggctgtgctgtgtccagatgggctccatggggcagtggacggtcactttccagttaaggactgagggcccgcagtccaagaacatgaacccccattgaggaagcccaggaatcctattacatggagtggggctcggcagttttaaggcatagggaggattcccccagtgggagggagaacaaagtcatcataaggaaggctcagcccctgcatggtttgggaatcgtaaaattcctatgtcaacggaaccaaattggggagggggctgggagcaagctatccctgctattcctgcatccccctgctcttccctatcctgaggacaagtgctttgagatcaatggcaaaagggggcctgcagttcataggcttcaaggaaaggcctccactatagaaaggcctcccattcaaagctgagaatgagtggtgggacaggggcaaggcctgcttcccaaagaggtggcagcataccacagggcaaggacagcaattccctttcccatttctggacccatggcagacatggctaaatgaatactacactccttccatgagcctggatgtagcctcggaatgcaccaggcaccactaagaaacttgaaggtggcacttaagatacaacttcttccctaacccagggtcttggtggttgggagtgggatgggtgtcggaggctccctgggagggatcagagtcagagccctgtctttgcaagtgtcacacccctgctctggcccactctgagctttctagctccatccttccattccttcctgccctggtttaagtgcatttagtaattacttcattaataacagcaaaagctatttgcatctgcccaccagccaagaccaggctgctgcttgagggattcctgctcctctgctcagagagaatgatgtggtcactgatcactgtgagctccagacgctcccaggaacgcaggcagtgaagctgcaataccatctgggggctcaaagggaatttcctcttcctggatattcctggttcaaggctctagggcttacctggcccactggcccctactggttcaggcctgtgaagggctgagggtggcttcaccaggcactgagtagacttaaggcacaaagtcagtttctccaacccaggcagggctggcctcggctgccctgggacttcttgggagccaagccctcccagggagaagaaacctcctgggccacacttaaagcttagaagtccgagtctggcgtaacaggcaaaccccagaaagtccactaccaagccatcccccagggaacagctttaagggggagagccgtctgccctccattgactcatgggggtccacccaagtctcttagggctggatccgagccccctgctgatctcaaaggtgggcaggtcctctctccaaaagggttggctccagtctcaaaaggggaggcaagggagaatgggctctgaacaaatcagggccacaggcttccccttccctccagggcacctgaaccagccctccaaccaccatatctggaaagaggtaaactggtcctgtcctggcccctagggggtggcaggcaggaaggcccaagaagtctctggctctcaggttccctctgtgccgtgaggggcgaccagctggaacagcaactccagtgtgaagacttccagtttcaccagtctcgggtagggccagtgaacagcagagctggcctgcagcgggctccagtgtaacaccattgcatccagtgttggggggtgcctgggcacccctggtccctggtgtggtgctgcctcaggagggcagctcagtcacacaggcggtagaagtggaagtggtagtctgtggctggctgggcgagagcctctgaactgcagttggcctgaccctgggtggaagggcagtgggaaggtgaggtggctctgggggtgcggggcagatggcactccctgctgacattgcttgacactgtgcccccagccctaccacatactgtgcaaaccccccattcctcaagccccacgtcgcagacaggggtgcccagacctccagggtaggtgggatgcccctgctcaccagcagtgccacccggaagtggtaggtgaattcayggaaggacaggatggttattggccaccggtgagaggtgccctggagagaagggagagaggggtcaggacagactgctgcccttatcccaaccagcatctctcaccacggccgtcgcagtcctggggtctgtggggagttttatgaaggaaaaaagcagagaactttgaagagataggaaggagcatgttctgctttggcagaaggagcaatggcagctactccatgcagaccgtgcccgggactggcaggtccacagccacctccacstggsccctgcctccttcccagtcctgttgtgctgggttccctcacccactatgctctgggcacatcaaagtatttcattagccccatcctcagtacaatccagtgacacagtgctgctactagccccatcttctggatgaggaaactgagccacttcctaaaaatcacacagtgtggcaaaatcacacagctgggattcaaacccaggtctgtctggctgtctccctcacagggtggcatgcagcctggctgcaggcagcttgcccatctacctgaggctttggctgtgcgtctgtgatgtggtttcaggcccgagcaccatgtctgctgtgtgtctagctgggctctccctctgtcttggacnctgtctcttctgcagggcgacagggctcgggcctccctcagaagcacccccacctctgttgcaggtgctttctgcacgtcttttctccctcactatagagtacgttcttggaagtcaaaacctgtgtctactccacctctctcccctgcagctaggcccacccagcacagggcctgggacagatggggccccaatcaatattttctgagtaaacacatgaatgggcaagaaaaaataatcactacttcccttcatttgtcctgagcgtcttctcccatggcctcttaggctcaagaagaaactgggggtccatcagccccagggacagtcataacttccggttacctggccagggaggagctcaccatccagttctcccagaagaggtggccaaacatggaacctgaggggccctctgatgctgtacatctagctgtgccacttccccaacctgagcatgaggtcggctccttcctgcttctgcagacacctccagtgagccacagccctccccgccatgggctcccagacacctgcctgtttccatcattgcactcatccacattagcacctgtgatctgctgtcttccccacgtctccagcacggcagggctgggagatgctcagcagagtgcaatgaacaaacacgggcacgcgtgcccctccctgggacacagaggcccaggccccagagtgtcccttgtggagaaggctttactctataactcccagcttctgctccttgcccatttkggggcccagttgtgccaggagagaagcagctcgggcctggccggcccgcagcttcccagtcccacctacctgggtgtcctggtgggtgtggagactctgtggaaggctcccctcctcacatggttcctcctttgacctcaggctgcacagcaccacagacacgggggaggaggagctgtagacaggcccagttagcagagaaatgaggttctagagtccctcaaccccagccccctcccagccagcctgccacacgcctctgaatctccacccagcctgaaacaccgcataataaccagggccctcgaacaaaacctttcccatcgaccatcccatgtggtcctcagcccatgaggccaggtcatttagccagttaaccacgaagtaggcaatgaagtcagcacttatcccaccatgcaggaaataccagagactctccggctgtcctcagactcggctgttctgaggctctgcgggagattctccctggctcccctcctgcctcccacttccccacaccggcactcacttcatctgcagagtcaggctgaggtgcagtggggtgccactrctgacagggatgtggtaggtgaagttcccaggcctgcaggggcaaaactggcaccttagcctgagggtaccctgccaccccccacccccaccagggactcctcagcccccaatctgtactggagccctccagaagagacagtgtccaagggtagcctggaaaggggctacccttccttatgggggaggctcctccctgaaagggcaagttccgggtgatctgtaccacctgggctcatgtcacctgaggacctccctgggtgaggggagggagcccagcccacctgcaggcatcccctggagcacagtactgggaggtgatggacatcgaattctccagcacctggatggaggtcagggagggcactggctctgcaaggagagaggctgttggggcaggagtaaggtgacaaggcaggacacaaatgagaagctggcaagtctttccttgccagacttgaagcagtcactcacaccttagtatgaataagttccaggttatttttttccagacctccacaatggccagcatcacactacaccctttcctcagcagccctaggactacccagttcccatgagcctgacgtctgcctcctcaaaagaactggaacacccagaagtagggatgggtcttcacatcccctgccaggtgtgcaggagcccgctcgaggcctgtgttcctgactgcgggcatctctcccagttctgggttcagaaacatcagttacactggtagcttgaaatcagcagtgttgacagcatcacacaaatcaggctcccctctgccccgaggccgatgattacaccgctaccagcacgctgctcctcgcagcctccctgaacaaaccgactgcaggctggctggctgggtaggggtgggactgaagtgtgacaagtcagatgggggagacaggacttcttgctcatctagttcacatacagtcttgctgctgcctgactatccacccaggaagggggaagctggggccgctgaacatttgctggacctggtacgttttcagctctgaggcatgacccagggacccaaggaccccaacaggatccaggacaccctgtgtggtcaggacaggtatcagatacagacgagatggaaggtgcccttcccacatcccttctgggcaaattccaaaggtcctttaaagagtcagctcaaatgtcaccaactccagagaagttttccctgatcctccccaccttcgtccggattaagtgtcctccccagtcccaaagctacctgcatgtcccctcagagcctcatcacactgctgtgttttcatctctgtgaggtctttggggacaggggcgtgtccatcttcatcacccccagtcccctgtacagagccagccacagagtggcaggcagctcagtaaacaggtgcctggcaaacatctcccccatggggttcccccatcacattgaatttccatctctgtaagccacattttccaggctttctttttcttgaagccacaaaatccatcagatgaaagttggtgagagcagagctgcctggttgaagccaggaagcctcccagcctccccttcaacccccagggcagcccccagcgcagcccccagggtacctcagaggaacccagtttgaaaactacaataaaaggttctgtagctttgttaaaaccaaagatccaaggtttgggaaatagtaggggagacccagtatagcaccctcctggtgctggcatggcgaaggaggagccaggctcgggatcaaatacaagccctgcctcggaggggctgtataaccctgggcaggtcacttcaccttagtctccatcccatttcttcagctgaacaataggaacaacaattcctttcttgcaggagtgctgtgaggactaaatgggatgatctangtaaggctgcaggcctgattcctgatccttattctgtgctcagcaaacgtctattgactgacaagtctgaacccagacagtcacatgactgggctgaggtgggccctkgccagtgagccttgccaggctgggctgggtagtgtcaggggtgcagcaagtacctgactggccctgggcccaggtgggctcagcagggcccacgctggactggagggcccctcggcgggcccggccatggaaaccaaggctgggactgttcttggctttgccctgccccccagggaaggggactgcagggctggccagaggctccagactcttgtgatgcttggagtggccaatgccattgactgaaagaccccaggacttggctctgatgttggtgactggcagaagggccatctggctggggcctgtggatagaaccaggcanaggctaagaagctggaagctggctgcttcctgtccagctgtctctagggccccacaagactgagtgaaccccatgtgtctcttggtcctctcaggggaacttcccagtcattgtccagagcctcgttctaggctccaggagaccctcccancaatgagtatttgggcctttctctctacgcaggtagcccccgccccaagccccagcccacagaaagccttacctgagyggttggtgctggggctgggacttgggctgagaacatggccagggttaaagctggggccaagactaggaccagtggtagggttggtagtgggtgaggaacagcagatgacagggcaggggtggctggaacacatgtccaaggtgcggacagcagaacctggggccgagctggtgaggctggtggtcactgaggaggccagaggctgtatgagccagagaagccccaaagacagaacayagcaacctccctgtcctacccagacctgcccagacacgcacccagcagcaaagagggctgtatgcctggtagccccgtggtcaagggggactgtcggagctgcgtggtcccaaagctctggctggacctgctggggaaggatgggctgagctcagaggggctgggagagcttgaggggagagggcctgacagtcctggagaggcaggagggcaggaagaggcagagagggaggggagggaggcaggaagaggggcagcaggagccagaggagaggggcgctggtcagcacgtaccatgggcacaaggcctcactccccccagggggctggggccggagcagggccaggagacaggaagtggacacggcaaaagagctaaggggcagcaaaaaggcaaagggtgagacaggcaaaggggaagagaagagaagacacagtcagaggtggccccaggagctgggggtgacagtgggctcacagagcccaaggccctgccctggccctccttcctcctaccccatgttccaaccccagcccctcagacagccctgactcgcaggcccagctacctggaggggcactaaacaggccagacagaaacatcagcgtcagcagggactgggaaaggctgcccaccctccaaggaggccctccctggatccccacagcaccccagcaggctaagaggctaaggatgaactcctttagagaagacagtctcatggctctctgacctgggactgcccaccaaagccccacctggcctggcagcttggcttggcctccaggaacctacccatcagtgtctaccaggtcctcctctgtgcgcaggctcagcacgtacagtgtggacatggacaccacgctggagccacagaaaagggtgaccgttagagctggagccaccatccagtgccctctctctaggacaaggctgtggtccttgctcctgaggctgggctcccaggtgatgcctacaaaatgggtcaccccagaggggaagaggcagaaaggcccacctcaccgagacctcagctgcctgatctcccaagctacatcctcctcttcccccaggcctgagcccatgggcagctgactccacygggcagctccactcccctagtcagccaccatgagagcccaggggacaagtcacctgaaggccatgaccaccaccagggcaatgatggttccctgcaggaagcgctggctgatgcaggcctggtccggaaccacggacgatgactgaggaccaagaggaaaagtgcaaatgcaaagagggccaggctgaggctgtccccagtgggctctgctggaggtcngaggagcggttaagggggtgccccatttccccrggggcaaagggagaagaaagagaaacggggctgggagggctacagagtcacaaggagagggaagcaccagaggcagtgaggctggagaactgcaagccagaaagggaggccacaagggaggccccctttccaaccngcctgccatccctgctcacccctaccttgctggccaccttggggggcctcttcttgtgggggacgctgcccgcccgactgaactggctccctgcatggctgcagcaagagggccaggatcaggggtgtccctgggaagaagggtctcaccttcccccaccccgcacccctacctgaaggygcccgagctgccggtggacttgaggctgtcgagccgccgcagcttggccagcttgtggctccagcgctccagctcatcaatgcgcgtctccaggttgtctgtcagcttgcacagctccttcacggcccctacgttctccatgaagatgcgctcctgccatgggccatgggccatgggccatgggccaacacagagggcccagtcagccccgggagccccaggctgccagacatcagggggcaggaggggcggccactgtccttggccactgggaggccctcaaagtctccctaccngggcgggcccctccaatccagcctcggctcccacagctcctgtgcctgtctccgagcaacacctccacctctgcaccttcacctgggctgtcccacctgcctgaatggccctccccactccctgccagagctctcctctcctaagcctgaaggctgcagccccgggatctgcccctcggatgactggtgtctcagatgtcagcacttcactattcagctggggtggagacctattacatgcctccttggcgcccagactcaggacaggtaagtgacaaacgtcgtcctcacaataaaccacgtatttcagcctggaggtaaccatacgaggatgtctgtgcagttctattaccgccctcattttaccgggggtggaaggccatggccctccacagggtttctcttgcccttgatcacacaggctccaggggccaaatccctacccactcatctccttgaacactcaccccttccctgtggggtgcagagggcgctctggaggcagcatgagagccgagggtgctcctgcctctgctttgcagtgcccccagtatctatggaggtgatgagtgttccccagctggctccccacttgcctctgggctccctcccwttcccscacccacagaccttgttcaccaccaggaagttctctatggttttcccattggcaaagaccatgtctccggtgtctttcacagcctcaggcaagatctccttcacctcctgagcgatgacacctgggggcaggggacaagccaaagatgggtgggggggtggtaaagggctactcacagctttgtaatgtacagtgggagcaagactggagagggtgaagttctggaacccagagatttggattccaaggagccctggagcagggagatcccacgaaccagtgttcacaggattgcaattccagggctcaggtgtgaggttcctgggctggggtggggcggattcctgggggtaaggatcccagggcaagtgggtagtattctggcaggttaaaggtaggattcatctagcgcgaagggcgagggtccctgggccgtgattctcagatttccactgacaatggggcgaggttccggggacctggagaggtgcgattttccaaggtccgaggggcgggacttctagaaggcatgattcccaggggcgcagttccgggagtcaagaggagtaggatttccaggtgacagggggcaaggtcactgaggcccgaggtttctgggtttccggaccccagtccgcaccagcccggtccctacctgtctctggcgcggtggcctcgatgcccgcgctggcggcgaactcgggcttgtatctgtagtgcaccagccgcatgcgcgagatcctcttcaattgctcggtggtgtccacctgcggggagccaggcccgggaatgaacccctcctgcggccgtcccggagcaggccccggagcccaggagggcggcagcctggaggctgcagtgtggagaggagaccccaccactggagtggttagatcgggattcgaggccagcctccctcccttccttcccccgcagctccgcctttccgcgtagtcacgccccctccccaggagccccgcccccgcggcccgctccagcgtctggacccgcccggcccccacagccctgtccccacctcctgcacgtgttccttggcgcgcaggtcggaggggtgcataagcgagcccatgaccttgacattcccgtgcacaaccagcgcctcatccggccggtctgtgttgatgcccacgcggccgtggtggaagacggtgtcgggcacctgtgcccgctgccacaacacatcgctgtcgctctcgaactggcctgggttggaggcctaccgcgagttggggctggatcagtcctgggggatagggaggggacctgcagggccctgggagcagggggaaactccacagcagcccctccccttccagccagggtttctcactgcaccaagcccaacttgaactgtccctcccactgtgacaactttttgtcacttgtgggatcccagaagctaccaggcttcgtccacctccctgctttactgtggagaccctgcagcccagagagggtgggagctttgcccaaggccacacagccagtgcctagcaggatgagcatgcccactcctgactctcagtacccgggtacttctgcttgctgtttctcccagtcctggggagggctgtctacgccctgggaggaggtggccctcacccgcacaatgatgcgctctgagatctgggcggccagcgtgtagttctggttctgtgcatgagcctggagggccaccaccagcatgaagtacctgggacacacaggggtctcagaagtactcatggcctgcccccgcccccagggccaccctttccctggccagatgcatgttcatctcaccccctcctacagaggaggaacccgagcctccaccagggggcagaaattccccagggcccacagcaagaagccagggctgtttctcaacccagaagccaggcttctgctcttcccatccttaagtcaatgaagggctctaaatctcaggtctctcatctgtgaaatggctcagcctgtaggactctgtgcctggtgtgccacccagggcngtgtcttcctgcctcagaaatggaggggctccggggcagggcccccacctgctcacctctggtccgggttgggcttgcccttcttacgcatgttgttagcggtggtctcgctgaagtgcagccgccccacagtcaccttcgtgacctgctcagggggcagattgaccctgcagaggagaggcagggtgctcagggggcagggagggaggctgcaagagccacgccactgaggggcacccaggccagcaacgtacatgaggcggacaccctgggtacctccctggcccctccattcccaagccagctttagttgtggacccttctaggtaccacccccaacagggtcagacactcacgtgaccgggttgaagggccgcttgctccggtctgactgggactgctcgatgttaatggactggttcagggcctccagctgtggggagtgaagccagtggcacctcrggatggggctacccggctggtcctgccctcctgccccctctcagccaggcctggcccaactagagctcaccaggaaacagggcagcacccagccctcagccgcgattcccacaagctcagatgccttctgcatggtcacacccccccacaccctacttcacacccacaccctcctcacccctcacagcataccactcccccaacttctgcacagctacgcatgcagtcactccccaaacacccacacccccattccacacccacacgctccccccacctctgcatgtatgcactcacacacagacacacacacacactcacagccccaccctccctcatgtccatacccacacacctcacagcagcctccaagcccatccacttgcacctaggcccactcactccccagatcctctccatacccacgtctcctctactcctccacgtgcactggcagagccatgccaaggtaccatgcctggctcactcatcacaccgaagccgacagacccagccatgcccacagggagctcatagactcaaaatcagccactactggggttgtgctgtggtgcctcccaatgggtcttaggggaggggcccctggggaggggaccagcatggagtctgcctggagaggagggatgggtgttgggaagggcatccaaggcaaagggagccacagggtggagggcgggggctgcgatggtaccacaagtggcagagctggagcggagggcagggcccccaaggcccccgtggtgcagcttggaagccggggctttgctgggaggacactgggggccttggaaggatagggagtgctgtggccccctgagtctcaagtggggcaggagttgggggtcccagctgctgtggacattccgacaaggaagggaggtaacccagaccaggggatggacaggaaagaggcgaggaccggaccaggtagagggatcttccagggcaatagcaaggccagatgcatgatgaggttggggaaagagggccctgacccagatttgcggctcakgtaaccaaggccctgcgccccattccctgagaggggagcccagggtgggaggcaagtgtgcagggagtttagtttgggacctggagctgaggcacctggtagagggcccaggagatgggtyttgactggggttgcagacttgggaatcacaggctggagcaggaaacggggcgagagggaggcagggaggcaaggaggcacagagtcagggtaaggtgcccaacgagagggaagcaggctgaggagtctaacgtttaaggggcaggcacagggcgaaagggaggcagggaggcaggttgatgagcccaacaagagggaggcaggcgcagggcgagggggaggcaggctgaggggcaggcacagggataaaaggcgggagggcggggtggcagtagcagtgggggagtttacacacacatacacacacacacgcacacagatgcttgcttttttttttttcttttttttttttgagatgaagtcccgctctgttgccaggctggagtgcagtggcgtgatctcagccccctacaacctccgcctcccgggttcaaaggattttcctgcctgcctcagcctcccaagtagctgagattacaggcccgtactaccacgcctggctaatttttgtatttttagtatagatagggtttcaccatgttggccaggctggtcttgaactcctgacctcaagtgatctgcctgactcccaaagtgctgggattacaggcgtgagccacagcatccagccaacgcttgctttttctggggtctttcagtgcccccaaagggccctcctgccctcccttccttgctgagccccaaacttgccttcactccgtgcagcttcagatagaagcagtcgaggggcttgaggccctcgggcgtcttgacgtacttgggctcgcccagcatgccgatgtacactgtcacctggaagtggttcttcttctggcacacaaaggcgtcgtcgcccaccgaaaagttgaagcccttgtccgcatccacgcggtaggtgagcatgggcctgggggggcgggtgagggcactcccctgaggccccagagccgggcctggaacatcggttcctcctacctgctgggttccaaaaccatttcccacaccacacccctgcatcytcaaaccaccaatgyggctgcccccactcctgagaaatggaaactgagtcccggagaggattctagtacagggctgcaaactcctcagacaacattctctcctataccccatgccttaggccaccgccccgccctggtgatgggggaagcagggccagacyctgaggcccaccagactggagggaactcctgagtgggggagggcttgactgccctccccacactcggctccttcccagaaggctgcctgaagccccctcactcacccgagagggactgtgtctgcagagcctcacagcgcctgacagctagttgccctggaaacggtggaaccaggcgcctgctctgctgcagacccagcccctgcccaccggcttgctcaagcccccagatgccctcattcccactccctcctcattcctactccctccgtctgcccggggagggaaggggcactcctggactctccctcagactcagcctcagtttgcccatctgttgctgggtttagtgtcccatgtttggcccctttgagacacctctagttgacagtaaaaagagcaactgggccaggtgcggtggctcacgcctgtaatcccagcactttgggaggccaaggcaggcagatcatgaggtcaagagtttgagaccagcctggccaacatggtgaaaccccgcctctactaaaaatacaaaaatcagccgcctgtagtcccagctacttgggaggctgaggcaggagaattgcttgaacccaggaggcggaggttgcagtgagcagagatcatgccattgcactccagcctgggcaacagagcaagaccctgtctcaaaaaaaaaaaaaaaaagagcaactgttggcctgtggcttagcgcaccctcactcaggtccccaggcacaagagtggtcacaggagtgcccagtgctggcctggcggaagctgggcagggagaatgcttccaaacttgtgggaagaggcctctgggcctggccagtgttgccaaaggcctgggctcaccacctcttccctcctggagctccacccacctgcctgacctakcaaagcacccaggaagtgcctgggccacttccggggctgcagctgccaagcttcctggccttggggcctggggtggcaagggtggcccaaagagtatggcagtaagagtaaggggtttcctccccatgccagagaggctggagtgccatacgactgcacccccacctggcaggacttcatgggacccttcagccaccccagcagccagatgcccccaggcctgggactgctggctaagaattcccccaaagcctggagcacccaactccatgcagctggtctaatccactggcccaggcctggcaatatccacagttaccctgtcacctgcccactggccttctgggtgagccaggggagtggtccccacagggctcccggcctgcggcctggaaagatggagccatctgggtgttgagggggtgctaggaatgctcaggcagcctctgaccggatcctccccagcccctcctccctccctctagggagggggctgccgggagggcccagcttgggctcagcttccggctaccttcctggaatgcagagggaggaggtggggaaggaggaacygggggaaaaaacacccatctgcccacttctccctgacttggttcccagctgcccctccctggcagtcatcaccttctcagggaggcctggggctggcmtaggagtcaggagccctgactgccagtcctggctcttccctgagcctgtttgctcttctgtgaaatgagtgctcccaggccctgctccaggaccttgatggggtcctgggctggggcgtcccaaggtgggggggcctggaggagtggggagtgttgtagggcactcacagctccttgtagttagcatcgtacaggntcgcccacttgttctgctgatgaggctgccacttgatggactggtagttggggtccaggtaggagccactgaggctgtcactgtcctgcaggaggcctggagggagggaacgcccatgtgggccctgcaccttgggtcccacaccccaccttgaagagttggccagccatgtacctggggagggggcacctggcgggtgccaaggcggtgtctggacacgggcaatgctgagaggcaaggaaccagggcccggggagagcggaccctggggaggccagggtggcgatggggctcgagtggggtgcagaggcagggctgtcacggtcccaggctcctgtttgatcattccattcagcatctgggcattgagggtgctsgggggggattcagagtgcttcctcttcttggaggggtgtgtagggagcctggggaaacagaagtgtgcgccgtgggggctggctctccccgagcccctcccactgggtagtatccacctctctcccctctctagcctgtttgggccaggatgtgccccgcccagaggacacctccttcaggaagccctcaggctttgcctcctcctactccccattgctctgtgctgtcattttctgcttctgtcactcttcgcttcccccagactgtggacaggagccacacctgacttggtgtctccatcatgcccagcaacagggctggcttacagaatcacagcaatcgcttgaggaatgaatgagtttgtccctgcctgcagtgtcacactcaaggtcaccctttatagtgggggctcnatggagagcaggccctgtgatcagaaacaagccacagagggcctgggccacaaaaaccagggaaggggagcttccgcacggcactccttccccttctggtttacaaaatgttttgacagcagaaccttcctttgaactaaacctttcatggaatctccacatgtaaaacagatgaaaagacaatcgtgcaggttgagtcagagtsgggggcttgggtctaggaagaagactcctcagaaacctgagggttccatgagacagctgcaaaatcactggggtctgggtaagagcacagccccgggcccagtcctggctctgcccctggctcatgatctggacgggacatttcccccatcagagcctcagtttacctacctgtgcccaccagataaggtagttgtgagcaattagccatggctgtaaacccctcaaggtattgctgggtaaacatgtataaatatgttacccccatctgccctgcagagccttctgccctccctgggtgcatcccggtccctacctccctctctggcctgcccgccgccctgcccaccctggtccctgtaccccaccttcccaccccatggagccagccacccacgtcttactcagctccgtgctgctgcaggagctggtgcagcatctgggactgctgggtgtggtgaagatcagtgggcaccagcccctgccccatggcagcgtagtgggggatcgggggctcggccttcatgtacagatcccgctgcaggacagggtagtgaggtgggggtggtgggggtggcggggggcctggcaagtgggctggaggtgggggcggatgctccaggcgggagggcactcccacgtggcacagtgtctcaggggttatcgtgcgcaggaggtggggctctgcaggagagatgggggagcgggcatctgagaccaacctcactcaggctcctgggcactgtcctccccaaggcagagtctcctgcttccaccccgtcctgagccaagcccgggggctgccccccacctaccctaggtgggagggccgttggtcagccacctactagaggcctgggcagggaggcacamacctgcccaaggaggggcagcctttcacctcatcctayccacctcctgcccccaggctggaccaggagaatccaacccaaatctaaaggtccccctccgtccccatctcctctgaggcctgctcctcctctgggcctcaggaaggcgtctccggagacccccagcccaggcctgcccagtgttcccctctccggcaggcagtccctcttctgggctctcaggggccagccccccagcctgagcggggaggccccagctccctttgttccccaggaggcattccagggatgtttttggtaagataaacagaactcttgaccccaatccggactgcggggagcctgctcccgcggtggttctgctcttggccacctgggggccagggcacccmtgagcaccctctaaggtgaggtgggcccggcctgggaagcctgcacccaggctgcacccacggccttccccagccacccacttaccgccgaagggtgcgtccatgatggcgcaggcgggcaggcgggtggcatcaccgcggggatacttgctcagaggcagggccaggctccccacccgcccgtggggaaacaatagccaagcgccagggagtatttgaccagcgataatctcagcccgttgggcagccgctggccccctccctcctcccctacctccctgataaggccgccccaactacttgcccaaaccctggagcaggagggcggtgcccgctggactcaccattcacctgctggggggagtaggcctcggagcccgagtctgggggagagtccggcagtgtgctgcgagagccaggggaaggggccggggggtgagcagctgagcttctgccttccagctgggcagcttctctgcgtggtagggtcccacagccccccagaagctggcgacactgaggtttcgtcacatccacccttaggggcatttctcngcaccacccacattggggtgcctggcagggcctggggccgaattgtgggtaggggaccgcccaggatcccctcagacctacagggcacttggggggcagttactagtgtccttgatgatggcacagggactcaaagactcccgccccagaccraaggccaggacttcttctctcttcctgcacccactgaagccccacagcttcctggaaacacagggccctagggggctgggcctcagggcattcagcaggtcatggggggctgccccaccagaggcaggtgtggactgggaagggagccagcaccaccgggcctgggtttatttttttcttgcaggtttcacttttatcagtgttcaggaaaaagaacaaactcaacccaagaggtcaacacgtcctgcgtgaaccctgtgctcacccagcaagtggaaggctgtggccatatgggatccagctctttggccatccctggtccccacatctggagcaactccccattcccatgcccagggaactgccagagaggccatggccctgttgtggacacagccctggggctggctccagagtccccctgcatccctgtgccagccacccacccaccttcggggcctcatgtagaaacctatacaacgattcaagaacacagaccctgcaggttttgtgtgaatgatacaaaaacgtgtatggggactcaaacccatactcctcgccacagcctcaggccccctgggctgccactccgtcctgtacttccctgacaatggccaggccttctgtaatgtgttaaggtctttcacaccctgcagtccctgcagtcccatgccccaagtccacagcaccttgtgttctctcctcttaagttcctctggcacctgattattcctctacttggagatgtactggtgaatacctctccccagttaggcttcaggagccactgcagagccgtgtgtctgttttttttcttttctttcttttttttttttttttgagacagagtctcgctctgtcacccaggctggagtccagtggcacaatcaccactcactgtaacctccacctcccaggttcaaacgattcttgtgcctcagcctcccaagtagctgggattacaggcatgcgccaccacacccaactaatttttgtatttttagtacagacagggtttcaccatattgcccaggccggtctcaaactccaggcctcaagtgatctgcccacttcagcctgccaaagtgctgggattacaggcatgagccaccgcacctggccttttttttttttttttttttttgagacagggtcttactctgtccctagcagtggcatgatcacagctcactgtagcctcgacctccctggctcaaactattctctcacctcagcctctcgagtagctgggactataggcacacgccaccacacccagctaatttttgtattttttgtagagatggggtttcatcatgttgcagactggtcttgaactcctgggctcaagcaatatgcctaccttggccttccaaagtgctgggattacaggtgtgtgccaccacacccagcctcatgtctgtcttgtttatcacctagactcaggtctggccctgggtcccttcctggagtggccctgcccacagagtccctgtgtggctctggacaagcccctttccctctctgagcctcagtgtgccattaaaatcctgacggtagcagtggccagggctccttgtggggtctcccaggagctggatacccaggaaggctgatgagctcacgcaatcataggcacatgatacagcagtgggcaccagcaggcgcttaccaaatgttagttctcctccctctgcccccaggggcctgtagtttaggaacagcctcacagcctcaagcaaacagtttgccttctgcagcaaaggttcacccctggcaccccaagcctggcctccactcccttctccccaaaagccagggagctcaggaagcacggccggccatgtgtccatggccaccatgcacccagggcatcctctgtgcccttgttgcttcccacgataatcttgaggggtaagcatttgagggctcacttcacagaagaaactgaggccatgggttaccgaggcagacggctgataaatggggaagctgaagttggagccaggctgtctgaacacagagttcatgcacctagtgttttaatgctcttccacccagagacaggggcccctacatttgccctgagctcccctgcagacccatgctcccagcctcccgctgtgagcatgtgccccgggagctgccctggagtctggctggccgggtggctgcctggaacctttggtcaaagccaggcctaaggttcagccctgggtcaggcccttggtgtggactcctcagaaagatggggggaagggcctgggttctgggccccatgaggcttgcttgggtaggggggaactgaggtgccacatctgagccatgggccagctcctgtggccacagtacacgtcagctggatgcgtaagtgggtgggcttggcgcgcgtgcacgggtatgcaggtgttcccatgaangtaaacagtcacagcctccagtcccgccgcttcctgtccactctccacacagcatcgagatttttctagcacttacgtcagccctcatcactcccatgcttggaagctttgtggctgcccactgcctcagaacaaagcccaggagtccccccttgacctggactcatcctcccttccctcacctgcccacgcacagccagtcacccagcccaacccatgccaggccagtgtctagcacctcccaggtcacggccacagccctgctccctgcctgcccctatgccgctgtatccccctactccctgcccttactcaccctggggcatagggagccttgggctcagccttgatggggggcccggtgccccccgggaagggcttgggggcagcgcccatgccgttgttgttgttgcagttcagcggggtgccgtagcccgggggtgggaggggaccatggcgccccggggagggtccacccccaggggggctcaggtggtggaccccgctggagccaggcatcgcaggctgcccgtgggagtaggaggccgagctggctggagcagagatgtcagggaagcagctgcggggaaggggggcggctcagctccagccaggaccccagccccagcagggaagtagccgccccctccctgcagggaactatggagatttcggaggagtcagtggctgggaagggacgaggagcagctttcagaggtgggaccacagcagaccccaggtccggccctcagacctccctggtgacagaagggaggcgaagggctggggctgggcgggtgcaggccgggcgagggggccactcacaggtcggaggcatcctccttgctgatgtactcctccaggatgctggtgtctatgttggagggctccagggcaccgttgatgtcgtggcctgcagggcaggagagatgggctagggaagaggcccagctccctgcagaccctgggcttcagggcccagccctccatccctgcccaggctggccctccaaaacagatgcccctgctccttcccacccaggtatccatgtgggggccggctctcaccctccactgcctggcacccctccaggaagcactgataatgcccccccgccccaccacaaggccaccttgagtctcagaggaggagaggggcccagggcatggatctgggtacagagaggccgatcctgccatgcctctttctagctgtgtgacagggaacaagtcctttccactaatctgtcaaatggggtcactgtgcctctgtcttatggggtgctgtgaggcacaaatgaggtgcttactgagtcgagagccccgtgggtgcccactgccctcgatgggatggctcggacccaacaggcactgtcctgccgtgtcctccaggggtcagtccagatggcccagctccaggaacgcaggagcacgaggcctggctgagtgggaccatatatcctgggggcccacagggctgtgggagtctcctgcacccaggccctggccgcaggcgggagtggggatcagaatcaggagagctccctgcaccctcattggatatgcccatcaccctgttgggcacaggcgggggaacttagccccctttttccagaggaggcagaagcctagagaaggaagggcttgccccggcctcccagcagggaatgatggccgccagagctccactcctctgcctgccgccctctcctgggccctctgcgctggccccggccccaccaaggggaggggcccctagaggaaaggcagccagggctcttgggcatcatgagggaggacgggggaggtgccggcctttcccctcccagggtcaccttgcagggggagccagagggcggggtgataagggggctgacgtgggagatgcgtcaaccccgataatggaggacagccccacccacacggctgacccgggctggccagccccactgaggcagganggcccctcccacaggcctctggagcctgagtctggggtctgccctctcctgttgagctcagacaggtccaggaacaaatcctggctcagccactccctgctgagtgaccttgggcaggtcacatgcactctctgcgcctcagtctcctcattcgtgcaatggggacatgtacagctatggcttcaaggggctgttttgagtatgaaacgagatgaggtgtgtgaagtgccagccactttagtgggtgctcatcggtcggaacagccgtcctcacttcccagccccagagccctggggtccccgggagccccccgcccaggcccctccctggcctcagccggcatttcaagaatgctgagccccgcttaggtgattaatgagcggctaagccctcctaggagtcacgcgctgcctgcgacaggccagggccctcctgctgacccccacccccagctcgcccagctaggaacaagggacacccaccacgcaccaccaatggccgtccagggcggtgtggccggggcaagagcagcttctcgagctgggcgtggccagtctgtgtgcctgggttccaggaccctgcctctgctcaagccccaccctgctgtaaccacgggtcccatttactgagtgcctactgtgtgccaggcattttgtgaatcaaatacattaataatcacaggagtttctttactttatttcttttttttttgagactgagtcttgctcggtctcccaggctggagtgcagtggtgcaatcttggttcactgcaacctccacctcccaggttccagcgattctcccacctcagcctcccgagtagctgagattacaggcgcccgccaccacacacggctaattttttgtatttttagtagagacagagtttcaccatgttggccaggctggtcttgaactcctgacctcaggtgatctgcccgcctcagcctcccaaagtgctgggattacaggcgtgagccaccacgcccagcctaatcacagaagtttcttatgcgcaaggcatcctgcaggctcttcacctgcggtgtgttactcaatcctcccagcccagaatgctgaccatgacagagacagtgacttgacagtggctcatagtgagtatctcccagtgcttctcaactcatcatggcgatgatgacaaagacagtggtggtgacagtgactgcagctcacactgactgcctaccacgccagggacgattctaagtgctttatgcattttccctctctaaacagtggggatgttcagataggtaacataatcaccatcccctgttcagagaggtcaagtctcttacccaaggcaacacggcaaggaggattccaaccaggtgcaggggtctgactccacgagggagagtgtgactggcggttgctgtgccttccccaccccacctggagcgtcgcccccaccctggccgctgaagctgcaagtttttgagcctgaacttggaatctacggtgaatgatgggctgatgcagtcatggtgttgctatttataacagacccagccccctcctctcctggccaggagcactcctaatcgcccctaatcctcctgcccacctccctcgggatagggggcctcaggcagaggcatcctgggagaccctaacgagaaccagatgtgctttgggggaggagggaccctcccgtgccagggtccgggcggacggaggatggaggaaggaggngggaggagggaactgatggggcagcgttgcggggaggccagtgggtggggaagaagtttgagggttgggggctcggagggcctcctgaggaacgctgaccccacaccttctcctggaagccctggaggccgcgtcgtctctttcccacgccgctcggcccccagcccgcccgtgaaccacactggagatttctaacagactttcc

SEQ ID NO: 10758 - DNA, 17799 bp, Homo sapiens
  misc_feature (1)...(17799): n = A,T,C or G, or insertion/deletion polymorphism (see Tables 1-2)
agacaataactaatgttggcaaggatgtggtgaaatcagaactttcatacactgcagttaagaatgtaaaatagtggctgggcgcggtggctcacgcctgtaatcccagcactttgggaggccgaggcgggcggatcacaaggtcaggagatcgaggccatcttggctaacacggtgaaaccccgtctctactaaaaatacaaaaaattagccgggcgcggtggcgggtgcctgtagtcccagctactcgggaggctgaggcaggagaatggcgtgaacctgggaggcggagcttgcagtgagccgagattgcgccactgcaatccggcctgggctaaacagcgggactccgtctcaaaaaaaaaaaaaaaaaaaaaaaaaaaagaatgtaaaatagtgcagtcactgtgggtgcagcgcaccagcatggcacatgtatacatatgtaactaacctgtacattgtgcacatgtaccctaaaacttaaagtataataataataaattaaaaaaaaatagtgcagtcactttgaaaatcagcctggcagttcctcaaaatgttaaatatagagttagcatatgacccagcaatttcactcctaggtatatacccaagagaaataaaatcatacgtccatggccaggcgtggcagctcatgcctgtaatcccagcactttgggaggctgaagcaggtgaatcatgaggtcaggaattcaagaccagcctggccaatgtgatgaaaccccatctctactaaaaatacaaaaattagtcaggcgtggtggcgcacgcctgtaatcccagctacttgggaggatgaagcaggagaattgcttgaactcgggaggtggaggttgcggtgagccgagatcatgccactgcactccagcctgggtgacagagcaagactgcatctcaaaaaaaaaaaaaaattaaaatagtatgtccaaaaacttgcacatgaatgttcatagtagcattattcataatagccaaaaaatggaagcaacccaaacgtccaccagctgatgaatggaaaagcaaaatgtggtatatccatacaatggaatcttatccagtcataaaaaggaatgaagtacaaatagatgctgctacaacacagatgaaccttggaaacattatgctaaatgaaaagtgccaatcacaaaagaccacacattgtacaattctctagatatgaaatgtatagaatatgcaactctatagccaggcctggtggcaggcatctgtagtcccggctacgcagaaggctgaggcaggagaatggtgtgaacccgggaggcggagcttgcagtgagccaagattgcgccaccgcactccagcctgggcaacagagcgagacttcgtctcaaaacaaaacaaaacaaaacaaaacaaaagaatatgcaactctatggagacataaagtagattagtggtttataggggatgggggagagaggaaggcagaatgacttacaggatttctttttgggatgatgaaaatgttctggaattagatagtggtgacggttgcacaactatggatatactaaaaaacattgaactgtatactttaaatggatgcattgtatggtatgtgaattgtatcttaaaagttctgtttccaaaaaaaaagtcagatggggctgtacttatctgaaggcttgactggggcttaagggtctgcttccaagtggctcactcacaagaatgttaacagaaagcctcagttcctccctcaccacatgggcatcttcatagggctgcttgaatgtcctttttgttttttgttttgttttgtttttcttttgtcttgtttttgaggcagtgagatcctgcaactctgttgcagttggagtgcagtggtacaatcatggttcactgcagctttcacctccagagcacaagcgatcctcccacctcagcctcccaaatagctagaccacaggtgtgtgccactatacccagctaattgtttttgtttttgtttgtttgtttgttttttgagacagggtcttgccatgttggtcagcctggtttcaaactcctggcctcaagcaatcctcctgcctcagcctcccaaagtgttgggattacaggggtgagctaccacacctggtcctgcttaaatgtctttgtgacatgtcagctggcttccacagagtgagtcatccaggaagaagagcaagaagtcaggcacaatgccttttatgacttagtctcagaagttacctcacttccatcacattttatttgttagaagcaagtcactaagtgtagctcatactcaaggtaggggaattaggctccaccatttgaaaggaggagtatcaaagaatttctgcacatcttcttaaaccaccacagcttctaatgttgttctgtgacctagaatgatttctgtagtgtccctgactccccatctctctctgtctcttttattctagtttaataagctattgaattgaataatgtgtttcttcccatctactgagatgtttagttttagacacaagttgtgtctcattctttattccctcatacttagggctgggtttcattgatggcaggtatgctaggggctgaactacctggaaatgttacaggcatggtcctatagccatagatttgtactccataaccctaggatctcctggaagaagactgccttctgggcttcctccccagatgccagactctgtctgtctcactgggtttcctctcctggtctgcagtgggggctgccccagccaaatgggtgcgtacgttcccagatgtggcagcagtctcctaacaacctccagccagagcaccatcaggatctgcaaagcagaggccactgtcttcctgggaagtctgccagccaatgtctgggcacagctgggacactagggcttggccatttctgcccaattgggactcttctacaggcagtctttgcaccagagctccctgttggctggctgagactttttcagagtggcacttcaacatgaggctcttctcaaccaaccctccttcccctctcttcccatagatgtcagatctgaaacacagtcggaaggctttccctgcccagtcctgcttcttccccctttatctttcataggcatttcctctgatgaatctcttggacttctaactctaggttggcagcagtttcctagaggacccagctgacaccctggccctggcccttttctgtggctgccagatcccagttccctggggcatgagttccctctccacccctcctgaccgctctattccctcttccttcctctctttcgcaggctgtgtccacagtctcaacctgtgcctggcacatagtagattcagtaactacttgtttttgaatggacacagaatactctggagctaggcactgccccccccattctcctggcatagagagccacagagaggcccctgggtaaggctgggagtgccagctccatgggccagaaggaaggcacccttcaggcgactggggaaggaaggcctgaggctaggaggctgtgggagagccaagagactcccagatcccagggaggccttcctcacatgccaggggaagtcgaagctggcttctctctggatctgctgggtgagcaagtcactccttttcttgggccttactccatacctctatgggactatgggatgagaagccccaccctgcctgtctccctagggagaggcaggggtagtgagcttcaggtgaagtcatgtctgggaaaacatgaatgggaaagggcagggcacacggggtttgggggtttgtgtatggggaaggatggtgagagacagggatagacgatcacacagggaagaaggagaggccctgcccctccttctctcatgaacccccacccctactccccactggcacccactatgcaccctgcctcacccagacaggtggagggccagagaaaagcctcagaccctcttccgtctgcaggacccaggccttcctgtctcgctggtttggcccctctgctccagggcctctgagggacaccctggtggaaggcaggactctgagcctgtcttgtggctgactgacttgtttttgggtggagtctggacagaaagctcagtgacaccctccctcgaggcctgggcaagccccagcctgatgttctttgagacccagactggaaaagacctcaaagttcaactccactgtacttctcactgtacagtgggggaaactgagtcccagaaagggacagggacaagcctggagtgacccaggcaggtagtgtcctggccactgttcccacagttgccatctagcccgagctctcagatatcacagatgctgtggccccaaaatcttgggacttgctttctcctgagtaaactgcttcctggccaggggtatcctgaggctttagtgatggtgttttgggtgccaggaactgtgctgggaatcttacccaacatcctgtggagtgactactgtgattatgcccatgatacagatgaggaaactaagactcagagaagttaagatttccaagcctagggtctgtgtggaaacctaagctggacctgtctgacctcgaaagcttggctcctcgtatcctacctcccagcctccccaggtgatgggcagggaagggctcagcaatgtggaaaagggggcagaggtgggtggcagttcctatgatgggaggaagtctcagcatgatgatttttcaaacatcacaactcttcacagaaggactcacctttgttcagctacatccttgcccttggggaccccaggtctacctcctctgccaccactcgctgtattccacaccccctttctcaacctctggcaagaaggcgcttggtccctggactagccctaccctctttcccttctcttcattgttcccagctatgatgctttgagccacaggcccaggctggttctgaagctacagagatggacctgcccaccctgcagcccccttccccctctgccacacagtgagctctccttccccagctctgcccctggctttacctcactggggctcatcccctggaagagactcagatggagcctggggcagggggaggctggagaagcagcaggctaatgggcagatggaagacagacaagtcactgtcctggccagccctgactcccatccagatccccaagcgctgcattcccatcctctaagccctccccagctggagcctgtcacctgaggttttcccaccctcactgagcctcagtttcttcatctgcactatgggtgtaagcaccctggcctcactagatggttggaagctgggctttgggatccaggaacaatacctgggtatagccccttcctgatggagagattcctgtctcatgaggcacacatgatgcctgctgtgtccccccaggtggccagggatggaggtggccacagacatacaccctgggccactctctgccactctagggaccatagttccttcaaatccagagcatcagccctgccctgtgtggctctcaaggcctgttcccgctgcgtctcccccagttatcagaccaggagggttgctgcaaggccaggcccatgcttggagtcctaggaagcggggagccctggggctctgtcccctgagtatgccgagagcctttctaagaaccaggacttggcaggggagcaccccaggtggcactccctttcccagaagccttgggaactcccagggtggtagcttcagagccccagcccttccttcacccagccctggcagaggcccatggccccctgccagcctgatggaggtggatgtggcagccaccgctgtggtaagggtgagaagggtgggttctaagggactcctccaagctcctgaacccttttccttcccttcaaggagatgtgaaagccccagcctggtccccatcccacagcttagggctttggctcccatagtcccaatctaggcagggctggcagcaggtgactggatggtgctgagaaggcaggcagaatgggggcgtgggccctggcaagtgcactcctcagccaatcagcgtcctgcccggctggtggattcggttacaagcccaagatcaccccatactccagcctctttcctcctcctcccgcagctccattcattggtcccgccgcaccgggcctgctgggctccgcttccgttccactgctcagctgccgcctggtggggccaccaagggcaggcatcccaggggctttgtctgactggactgggccagtgcagaatgggggttcaggcagggctgtttgggatgctgggcttcctgggggtggccctggggggctcccctgccctccgctggtacaggacctcctgccacttgaccaaggccgtccctggcaacccactggggtacctgagcttcctggccaaggatgctcagggactggccctgatccatgcccgctgggatgcgcataggaggctgcagkcatgtagctgggaggatgagccggagctcaccgcagcctacggtgctctctgtgctcatgagactgcctggggctccttcatccacacccccggacccgagctgcagagagcactggccactcttcagagtcagtggsaggcatgccgagcgcttgaggagagtccagcaggggccaggaagaagcgagcagcagggcagagtggagtccctggtggagggcaccagcgagagaagagaggatggaccatgcctggcacastgtggtgtggagttggagattctgctgggaactcctcggagctgggtgagccatgaggggtgtgtgggctggggggtccgatcggggaagcaaggtttcttcagccccagcccttactctcctaggctgtgtgtccctgggggagtgacttgaccatggtgaacctcaatttccttatctgtaaagtgggggcaatcacgaatctcatcatggggtgcttaaatgaggtcacggttggggaaagtcttattcaaacctgggagtcctcattaaatgccatccgagggactgggcaggctgggggaggatccagggtcaactgagccaaaaagccattacccaggaggaggctttgtgggcacggggtgcccagtggaatggatgctgagacgaaaggcctgggttcaaatcccaactcagcacatacaagctgagcaagtcacttcccctctctggacttatttcctcacctgtaaaatgaaggtgatacctccctttcagggctggctgtgaacctggatgtgggaagtgccaggcatgtgggaaatgcttagtaaagagtgctattttttagatggtaataaacatagatgaatttcttgcactatcagtacagatgtctgtgcgtttgtgtgcagggttgggggagggcttggcacctgagtcagagtaggttggcatcctggcgacacctccttgtgccagtgagaaaggttgcaccctgcctgtttgccattccatcatacacacattcataattttggagttttatttggggcgtgggcttgggaactctggaggcagactccaattcccctgaggaagacctttccatgtatttatgggtgggctacctggcatttagagttgcccaacagaggctgcagcttggcttctcttttccagctttgaaactctgagagtcccacagaagggagagtgactggtctgaggaccctcatggcgtttgtgtcagggctggggtgagaaccaggtctctgccctcttcctaccaggggggcatagctggtgcatgatgcctaggaccctgctgagttggtgccctctcccctcccctccctgcaggggtcttccagggacctgatctctgttgccgggaacatgaccgctgcccacagaacatctcacccttgcagtacaactatggcatccgaaactaccgattccacaccatctcccactgtgactgtgacaccaggttggtggcaggcagcgagggcccagagctcagggacagggcagagttacccagttcctgggtaactagacattgggattgcagaggatcttaaagctcagccagcttggaccccacagtgcaggtaggaaagctgaggccagaaagaagggatgcttggaccccaaaccacccagctggtagtggcacagtgggctgtgggaggagccagacagccctccatgccccagggtcctgggtatctgttctggggcaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtacgtggccaccccctcatgtccctttccagacagagagggagcccaggctccaagcctggtgagggagagctatctgtctgtctgtcttccagggaatgatgtcccatcctgcatgtcctctcctgagggcccgggatgcagaccctccttgggtgtcccccacaacccagcgggatgggggatgggactggcagagcattgatctccatggagacgaccctgggggcttctggaagggggattcccagtcaccaatttccaccaactgccaccacccaggtgtaggatgtayggcacagtgcccctcgctcgcctgcagcccaggaccttctacaatgcctcctggagctcccgggccacctccccaactcccagctcccggagcccagcccctcccaagcctcgacagaagcagcaccttcggaaggggccaccacatcagaaagggtccaagcgccccagsaaagccaacaccacagccctccaggaccctatggtctctcccaggcttgatgtggcccccacaggcctccagggcccacagggtggcctaaaacctcagggtgagctcagaacctaaccttgggggttcctgacatgagggggtgtccctgcttctgtttaggggtggccatgtgttgcctcttttcctgcaccagtttcctcctgggatttcccaacctctcccatgaaatcacactgcagcacaggattttcataatccacgaatttgaccacatcaggccccactgtgcacccaccaccactcctctttatctcagccaatgatgtcccaacacccagaggccctcaagccttggccctgcagaccctacccccagtcaaaactctagtttcacaaacttcacttggttcctcaaaagcgccaggctctctcctaccgtgaggcctttgcacatgctgttcctcctctccttgtcttctctcccaccctcagtttagcagcctatgcctcctggaagcctttcttgactaccgtcagtactctgggtgtcccccatagcagtactacygtgtttggcggcttgggggtagggaggcactgccacaagggcggcacactgagggcacaaagactcagaaggcatgaaatggagggartctgtgtgtgtgactgagcacacgtgctggtgtttctcccggatggcgcaggcattggtggggcctccctggtggattgggctcccatcaacaccacatccacccctcaggtgcccgctgggtctgccgcagcttccgccgccacctggaccagtgtgagcaccagattgggccccrggaaatcgagttccagctgctcaacagcgcccaagagcccctcttccactgcaactgcacgcgccggtgaggcccctttgaaccctcgcggggtgggctgcctgctgccaggcatgggaaggggcccctggctggcaaggccctgccccggcctgagcctgcctctgttctcagtctggcacgcttcctgaggctccacagcccacccgaggttaccaacatgctttgggagctgctgggcacaacctgcttcaagctggcccctccactggactgtgtggaaggcaaaaagtaagtgatgtcagagccaggagggatggggggttttctcaaagggtgggttgcctatacycactttgaatgcttgggccaaggggtaggggaagggatcsggagacctctgagctcctatccatagcctcatccctctaccccctgctgccccaggtccagctctgcagttggcctctatgggtcgcatcttggctttgtcatttgattcccacatgaccttggcaactggttcacctttccaagtttccatgtctttgtctgtaaaatggtcgtaggaaccaaggaaacggcaggatgcacataggtcatgccccgcctggcacacagcaaaatgtgtacttaactcactcctaatccacaatctcatttggtcttgaacttctggactcaagcgatcctcccacctcggcctcctaaagtgctgggattacaggcgtgagccactgtgctctgctttcatctggattccgattctcaaagccagctccttcttaactttcccatttcatagatgaggctgaggcttctggctcaggtttccacagccagctagtggcagaacccaggcctccaggtaccagcccggtttattataccctttctccgtgaaacccacccctctctgccttgctggtgactgtggccccagccccctctctctctgggcctcagcccactgtctgcagagtaaggtgggatccttgtcagccctgatcatctgccccactcttctctccttacagctgttccagagaccctagggccatcagggtgtcagcccggcacttgcggaggcttcagcagaggcgacaccagctccaggataaaggcacagatgagaggcagccatggccttcagagcccctgagaggccccatgtcattctacaaccagtgcctgcagctaacccaggcagccaggagacccgacaggcagcagaagtcctggagccagtgacctcagtttcagctttcctgggcaccagcctggaccttgcccatggctatgccaagccttgggaatctcagcctcccctccgtaggttagactgaagcatrgcagaggctgttgtggacaatcaagaggatgaatggggggatctcaaggcccaaatgctggaccacatctcctgctgttctgggtaaccttgagctatgtatgacacaactcttctatgcctggatgtggtgttcaggaagctcattctgatgccctgggctttggccttgccagggaacttcacatacagatgagaatggggaaagggtaacttattgcagcagccccaggcagtaccaggaggaggtacatgtatgtccgtgttgcaaaaataatacatgcctcaaaaacctgcctaggggagccctagtgcctgggtgctgtggcctgaggtagcaggtgggaagttagggatgtcacagaaatgtctgtgtctgaatccaggattggggtgggtgttggagagggctttcagctcccctcctcccaggggggcctctttttttaacggctgccntgcccttcctggcccanccctaaacctaaattcaaatctcctccatgcctttgcgcaaaggacctccctcttgcactctaagccttagtttcctcctctaaaaaaagggggtctctaaacaggagctacctcatagggttgttgaggattaagtgaaccaatacatatacagtgcttagcacttaataagtantcccccctgcgacacctagctgaactatggtttggtgtctgatcttgagaggttgatgtaaccttttaaaggcctcagttcgctcacctgtgaaatgggtctaagaatagcactgatctcacagggttgtgatgcagattaaaggagatggcatgtgtaatgtatacagctggtgcctggtaaatgtcggttctgtcattccctcacctctttagtccctgcctctgactaccaccatcccaagactactaacaagtaggaaagagccgagagtgaggctggagaatttaattcctaatggatgacctccaggattgggacatctgccagagctctcccatcatcccagatgggggcctgggtggggctttgctgattgtcacagttgaggtgccaggactgagttttgggggaccccagttgtccacccctggccaggacagagaggcaggtgcagatacagctggaggagcagcaggagagaggcaggtgggcttgcaaaagattgaggcagaatggtggtcaccttggcccatctgcctaccccaccctcagggccccaggcccccttcctccagcccccgatggccctggggactaggagacaggctgttgggcgccagggcctcccgatcaggtccccaggagccaccaccaccagggtctacagtctctaggcgcaaggcgggcaacaggcccaggcttcgaggcacagctggtgggaaggcccaggggccaggcaacccagagggcccctcttcactactgccccggctgctgccattactgctcctgtcaggagccactcgggacaggcggcggctctggggtgaggggctacggctggcaccacggcgttcacgggatgagggccgtagggcaagcccagggaacctggccagtcccgggctgcggctgcggtgtcgcttggacttgccaggactggggctgcgggacttgggtgcaaggagctccagtgtgctgtcatcctctccctctgagctggtgcctgagctgtctgtgctgctgctggccaactccgaggaaggcagcgagatctgggggaaatgctggtcactggggcgccctgctccccaacccagccactgaggcctgacctcccgaggtctgcctctctcgttggcagatcttgggaggtcaggttatttgtctgaactcaaggagcagaatgtagaggctgtggcatttgacaaaagtctttaggcacccccagcccagcagtctggcctacttacctggaagggttcagtgatgccratgaggatgctgtggttgtgactatagtagcccaggatgaagtctccatggcccttgggcagtgattcctcactgaatgttacctggtaggcccaggggtataagcctaagttgggggtcagggaggccacctgagagcccccaaggtgagttctgaggtcccaaaggcaacaaggacttgccctgactctcccactccttttaagtacctggtakgtattcccatccacatcttcatgtttggcccagacataagccacatagtccttgcaatggcggaaacccacctgggggatcagtgttgtggaatcagtgttgtgaccctataatgtctgatcccagcagtctcccagtgtggcatcaagatctggacaagccagtgaccccaccatgctgttcagctgctcctccaggcccctttcttccctgagtcgctgaccaccactgcccctctcacccggtataagccgatccagtcccaggagctgcgggcgaacactgtttccatgcggtacctcaccaccgcctgctcgggcygcacccactcatctgccacctccagccgcaccagtggcatgtcgtccctgaaggcaaactgtccaggcaaggcaggggcagggggccacatcaggggagaccctctagtatcccacacacttaaggctcttgggtcttagcacaaattgcctgagacaaagggccactttacagactgggaaactgaggcagaacaggtctagtataaawaccaagccctgtgctgcctcccagcccagggttccttctgcccacagcctccttagggagtgagtgagaacatagctttgaagctagcaaatcctggatttggctctggttctgccgttgacaggctgggtgagttcctcagcctctctgaatgccagggccctcatctgtaaactcagagactcttttttttttttttctttttctgagatggagtctcgctctgtcacccaggctggagtgcagtggtgcaatctcggctcactgcaacctccacctcccgggttcaagtgattctcctgtctcagcctccccagtagctgagaccacaggtaccgccatcacgcctggctaatttttgtatttttagtagaggcagcgtttcaccatgttggccaggctgttcttgaactcctgacctcaaatgatccacccacctcagcctcccaaagtgctgggattataggcatgagccaccgtgcccggccaaactcagagactcttattttactcttggagttgttcagcagattcagtgagacaccatttgcaaagcatcccataaatttcccagtataccagtaagtgctcaataaatgatttgtctctatgctagcaaggaagaccaataaaatcctatgatgcactgggtatttggggtaagctgaatattcctgagcaggcaagaagagctctgcgtgggaggatggagacctcagtccacttccaggctctactgctaactcgctatgttaccccagggcaggctctaaccatcccaaggttcagtttctccaactgagtctaagtactaagcggttactaactattaccttgtcatcagtccatgaaggaaagttataaccacgagtatcctttccccaaggtcaacccagacccaccaggggcgccacctgaatgggtggagctgctgaggtggcaggctgccaggatattgaccccacctctgtccctcagggaaggactgagttgttgccaacaccagatctttgtctgatcccctgtttacctagtttcaggtttccctccctcagcttccgagccaatctgttccagaagtaactggcacattctttccctgttcctgtgttcctaacagcaggggcgggcaagggtagacctttgaaaatgccctccaaggccttgcagcatcaaaacccctactgagccctattctgactgcattgccttggctaagagacttaagttctctgagcctcagtttccctcaccagtaaaacagagaggaaaactgggacatctcagggcctactgaggcattcaaaaggatgacatatgtaaagtgcactacacaggcctggcatgtagtaggtactcaatgggaattttttttttttttttgagacagagtctcgctctgtagcccaggctggagtgcagtggtgccatctcaactcactgcaacctccgcctcccgggttcaagcaattcctctacctcagcctcccgagtagctaggactacaggtgcgcaccaccacacccaggtaatttttgtatttttagtagagagagggtttcactgtgttggccaggctggtctcgaactcctgacctagtgatccgtctgcctcagcctcccaaagtgctgggattacaggcgtgagccactgcacctggttgggaaatgtttttaaagggacagagtcctggaggaggtgggaaggacaggatggggtgtcaaaaggagtgatttttcaggtgaggtccctaattgtgggttaaatcttcatgcccaacacttttgccagaggtcatggcaggccaagcgtggggatatttccattcccagctaaagatattggccaatgtcccactgactggccatgtgacaaagttaccaggaaaaacattttctggcctgctgggctccctcttatcagatcaagagacttgaagagcccagagttgggtttcagggctgaaaagatgggatctaccctgctctgccactgcagagcctgtgtatggtttggggcatgtgcctaccccatgaggagcctcagatcccgccacagaaaaaaagggagtgggccaaattggtctcacaggtctggttctgagattctaggatttcccattttgatgtcggcaaccaggaacctcaatcctaaatacaatataaattatagtaactacttaagagttcagctttgtattttttatatctttgctctccctccccatcactacacactctcataatgcttggcatatggtaagacagttaagtactcagtaaataaygaatgaatgaatatgaatgaatgttacatggagtttgattttgctggtcttattatatatgtgaatttttatatcttttctttgttatttttaagacactagtagtgaaaatgatgatgcatatgtgaatttttttttttttttgagacaaggtcttgctctgttgcctgggctggagtgcagtggtacgatcacagctcacagcagactagatcttccaagctccagtgatcttcccacctcagcctcataaatagctgggaatacaggtgtgcaccacctagctaaattttatttttatttttattttttccctgagacacagtcttgctcatgtcacccaggctggagtgcagtggcacgatactggctcactgcaacctctgcctcccaggttcaagtgattcttgtgcctcagcctcccaagcaactgggattacaggcatgcaccactgcgccaggctaatttttgtatttttagtagagatgggtttcgccatgttggccaggctggtctcaaactcctggcctcatgtgatccgcccacatcagcctcccaaagtgctgggattacaggcgtgagccactgcgctcggcctttttttgattttttttaaagacagtgtctcactgtgttgctcaggccggtcttaaactcctgagctgaagtgatccttccacctcagcctctcaaagtgttgagattacaggtgtgagccactgcgccagcctataaatgaattttaagataaattactctaaacctttctcagaagacaggagttagagattagcagaaaaggcacgggctctaaggctgggtgtggtggctcacaccttgtaatcccagcactttgggaggccgaggtgggcagatcaccggaggtcaggagttcgagaccagcctggccaacatggcaaaaccccatctctactaaatacaaaaattagccaggcgtggtggcgggcagctgtaatcccagttactcaggaggctgaggcaggagaatcacttgaacccaggaggtagaggttgcagtgagccgagaccacgccactgcactccagcctgggcaacagagtgagactgcattaaaaaaaaaaaaaaaaaaaaagggcgccgggcacagtggctcatgcctgtaatcttagcactttgggaggctgaggtgggtggatcacctgaggtcagcagttcaagaccagcctggccaacacggtgaaaccctgtctctactaaaatacaaaaattagccgggcatgacggcgggtgcctgtaatcccagctacttgggaggctgagacgggagaatcgcttggacccaggagatggtggttgcagtgagccaagattgtgccactgcactccagcctggggcggctgagcaagactccgtctcaaagaaaaaaaaaaaaaaaaaaaaagttggccaggcacggtagctcacgcctgtaatcccagcactttgggaggccgaggtgggtggatcaggaggtcaggagttcaagaccagcctggccaacatggtgaaaccctgtctccactaaaaatacaaaaattagcctggcgtggtggcgggtgatgtaatcccagctactcaggaggctgaggcaggagaatcacttgaacccgggaggcggagcttgcagtgagctaagatcgcgccactgcactccagcctgggtgacagaatgagactctgtctcaaaaaaaaaaaaaaaaaaaaaagaaaaggcatgggctctgaaaccagactcacttgggttcaaatcctaactgttcctcttactagttgggtgaccctgggcaggtgatgccatgtgtctgagcctcagcttcctcatctg

SEQ ID NO: 10759 - DNA, 25743 bp, Homo sapiens
  misc_feature (1)...(25743): n = A,T,C or G, or insertion/deletion polymorphism (see Tables 1-2)
cctctgtgcttgccaaggccatgtgcaattttatggagcctctagaagactcaagacactttcagaaccatctatataaattgctaatgctgaaaagacctgaatttggacaagatggtagacgaagtgttttcctctttggttggcaacttatgggtttcctcagaacccctgaaattacaaaaattggcagccacccattctgactccggaagtggtcactaagccacactgctttcccagggtcaggggctactctatgtagaacacaagagggtcccaaagggcacgcaaaaactccacagttctcacagttctcaggcttggtgtgggggaaaccgtcactcacggcccactatgccaatcactgatgggatcaaatcagggagggaagaaatatccctctcccactcatgtgtcctctgcaagtcaatgacctccttacgtttggtgtccttggtgcctccctcctctcaccctagtcctggccctggtgtcccagccttcctacttaccttccaattaggcccacttatgcccatcctgacccctggttctgcccctggtccaggtctatctggacttttcggcaggatcatggtacttggtcccccacctttgacctggagttcactctaaggccttcaccatcctcctatatgattgaattactattcccattggacagatgccagacgccagatgccagtctccaaggcataatcctagaggcccacagctgtgcagggacagaagccaggatccatcccagctctgatcaacttcactccagcctctccatgtcctgggccagcagaagggttctgctgtgtttgtgcaattcctcagatggggaggaaataggcctgggccagaatcgccaggaacacacattgatttggtcaggatttttctgacttgtcccaaaggaagtgcttcttggctttcatctccaagaaggagaactttggccctggtctcttcccaccaagctttttaaaagttaatgttagaagtctgaggaagatggcagataggagacagggctaacatgcagctcccacttggaaggaccggacagcatgtggagacccacatcatgtaataatgtgtgccaagaaccaccacaggaatgtaccaggaaaactgaaagaattcacagatcctttgaaagaagtggcatgctccttgccaattctatgagacaggcaaaaaactgggagttcccaaagtgtgagggagggaaaatctgcctccaaacacacatcgcccctggggaatctgaaaatccagattacaggagagggatttaaccttacccatagctgaaatggattcagagaaccatgcaaaatgtaaaagtagaagcagaagtgggaagaatcctgtaggcattcccagtgtccagctcaagcccagggcaccatccctggcggtatctcacagaggcctttggggaaagcagccagcagaatttgggaggggtcacagggtgaaagaagcttccagatggattttctaataatttctactgggcttgaattttcttgagcagaatccagggggagaacaggaacttctgcaaatatgagcccaggagccaccactgacactgtgggcagatggggagaggcaaggcctgaaagccatgcttgctttctcagtggagaagcttatggcctgggacaaggtctgagttctgcgcacaggctgcctgaatctaaacttggcattgttagtggggcactgcgggagcaaggccagccttgccaactgcatgtgatctgggtgaggcctctcgctgccagctatcccccacttccctggcgaactatatggcacagcagaggcagccataatcccctctgtaacaaaccccattggccttaggacaatctgcatccctcacagtggccgcagcaagccctgcttaaggaaagtctgagctcagacccagctaaccctgccctccacctgatggtatttctctacttatcctggtagctgaacacaaaagacataaactcgtgggagctttatggccctgccaatcacctgagaaactagaatacttaccctggtcaacctagggcaagcttgtatctcccttctactaccgcagctggtgctctcttgaaagtgccacttcctggctggagaccaaccaactcaggccattacagcaactcatgacagaataaccctattcccaggaaggagaagacaagagctaataccactgcccgcaacatcctgactgaccagaggtcctcagtctctccacatgacagcttcactgctagcataaccagcattggagaaaacagcacactaaagagaactacaaccaatgactctcacggagtctacttcactcgcctgtcacctacaccagagtaggtgctggtatccatggctaggagaccagaagatgatcacatcacaggactctttgcagacattccccagcaccaacccaaaggctggtatagccccagtgggtggctatacccagaagagcaataacaatcactgcagtctggctctcaggaagccctattcctaggagaaggagagtaccacatcaaggaataacccgtgggacaaaagaacctgaacagaaggagttgagtttcagatctttccactgaaatagtctacccaaatgagaaggaaccggaaaagtaattctggtaatatgacaaaacatatttctataacaccccccaaagctattgctagctccccagcaatagatacaagccaacaaaaaatctctgaattgccatataaagaatttagaaggttgattattaagctattcaaggagatagcagaggaaggtgaaaaccaacttaaagaaattttaaaaaatacagaatatggatgaaaattctccagagaaatagatatcacaaagaaaaaacaatcacagcttctggaaatgaaagacacactgaaagaaatacaaaaggcactggaaagtttcaacaatagactagaacaagtagaagaaagaacttcagagcttgaagacacagctttcaaattaacccaatcagacaaagacaaagaaaaaagaattttaaaaaatgagcaaagcctccaagaaatttgagattatgttaaatggccaaatttaagaataattggtgttgctgaggatgaagagaaatctaaaagtttggaaaacttatttgagggaataattgaggaaaacttccttggccttgctagagatctagatatccagatacaagaagttcaaagaacatctgggaaattcatcacaaaatgatcctcacctaggcacatgtcatcagggtatctaaagtcaagaagaaggaaataatcttaagagctgtgagacaaaagcataaggtaacctgtaaaggaaaatctatgagattaacagctaatttatcagcagaaaccatacaagccagaagggactggagtcctgttgttagcctccttaaacaaaataattgttagtcaagaattttgtatccagcaaaaccaagcttcataaatgaaggagagataaagtctttttcagacaaacaaatgctgaaagaattcgccactaccaagccagtactacaagaaatgctaaacggagttctaagtcttgaaacaaaacctcgaaatacaccaaaatagaacctccttacagcatattgttttataagccttagggcctataaaacaataacacaatgaaaaaaataaggtatttaggcaacaacttgcctgatgaatagaacagcactttatatctcaatactaacattgaatgaaaatgggctaaatggttcacttaaaaggtacaagggctgggtgcagtggctcacatctgtaatcccagcaccttgggaggctaaggcaggcagatcacgaggtcaggagatcgagaccatcctggctaacacagtgaaaccccatctctactaaaatacaaaaaaaaaaaaaaaaaaaaattagccaggtgtggtggtgggcgcctgtagtcccagctactcgggaggctgaggcaggagaatagcatgaacccaggaggtggagcttgcagcgagccaagatcgcaccactgcactccagcttgggtgacagagagagactccatctcaaaaaaaaaaaaaaaaaaaaaaaaaaaaggtacataatggcagaatggtaccggtataaaaataggcacatagatcaagggaacagaatagagaacccagaaataaagccaaatactttcagctaactagtctttgacaaagcaaagaaaaacgtatagtgcggaaaggacaccctattcaacaaatggtgccaggataattggcaagccacatgtagaagaatgaaacagtatcctcatacaaaaatcaactcaagatggatcaaagacttaaatctaaaacctgaaaccataaaaattctagaagataacatcggaaaaactcctccagacattggcttaggcaaagaattcaggaccaagaacccaaaaataaatgcaacgaaaacaaaaataaagagatgggacctaattaaagtaaaaagcttctgcacagcaaaataaataatcagcagagaaaacagacaaccctcaaagtgggagaaaatatttgcaaactgtgcatttgacaaaggactaatatccagtttctacaaggaactcaaacaaatcagcaagaaaaaaaaaataatcccatcaaaaagtgggcaaaggacatgaatagacaattctcaaaagaagatatacaaaatgaaatggccaaaaaaatatgaaaatgtgctcaacgtcactaattatcagagaaatgcaaattaaaactgcaataagttgccaccttactcctgcaagaatggccataatttaaaaatcaaagaagaatagaagggtgcagtggctcacacctgtaatcccagcactttgggaggccaaagcaggtggatcacttgaggtcaggagttcaagaccagcctagctaaaatggtgtgaatatggtgacaagggaaaacttttacactggtggtgggaatgtaaactagtacaaccactatggaaaacagtatggcaactccttaaaaaactaaaagtagaataccatttgatccagtaatcccactaccgggtatctacccagaggagaaaagttattatataaaaaagatactcgcacatgcatgtttatagctgcataatttgcaaccgaaaaaatatggaaccaacctaaatgctcatcagccaacaagtggatgaagaaaatgtgtgtgtatatacacacacacacacacacacacacacccctatatatgtatatgccatggaatattactcagctgtaaaaaggaagggaataatggcatccgtaacaatctggatgaagttggacaccattattctgagtgaagtaactcaggaatggaaaaccaaatattgtatgttctcatttattagtaggagctaagctatgaagacacaaagtcacaagaaggatacaatgggctgggcgccgtggctcacacctgtaatcccagcactttgggaggccaaggcaggtggatcacttgaggtcaggagttcaagaccagcctggccaagatggtgaaaccccatctctactaaaattacaaaaaattagctgggtgtagtggcaggcacctgtaatcccagctactcggaagctgagatgggaggatggcttgattgtgccacttgaagtagctatgattgtgccactgctctccagcctgggctacagagcaagactctatatcaaaaacataacagaaaacataacctcagaagcattacaataaatatgcaataagcatccacccagcatgtgtgggggactgtgctgatgctgatggcatgtgtgggagtaaggcaggcatctgaggaatgtgggggaacggaaggacggggagtaatctggagagccccacggtcagtcagtggcaggtctttcttgagctcagaaaggttaggtaactagttcagatcagacagtaaaacaggggcagagcctggaatygcactgaggcttgagtctgacttctctcccccacctgctgtgcccttaaactgcagagatcggggcgggggttggggggcaagcggctcagatgggttcaaaaaactccccaggctcaactctggttctgactgcctgagacatgggcagctgacacagcagaccttgaatcctgaggatgtgaggcaggtgggttggatgagagggacccggatgtctggtctgcggctgctcctctaagtgcagcagcaaggaggctgggcctggactgcaggtggtgctggggagcagcgtgtttactgtgcttggtcatgagctgctgggaagttgtgactttcactttccctttcgaattccagggtatatctgggaggccggaggacgtgtctggttattacacagatgcacagctggacgtgggatccacacagctcagaacagttggatcttgctcagtctctgtcagaggaagatcccttggtaagttggggatagtgtgatctacccccatgtccttattcyygcaatagctctataagggaaggatcattcagcttttgtagataagctcagagaggttaggtagctggttcagatcagacaggaaagcagtggcagagccgggatttgcacccaggcttgagtctgattgctccctccctcctgctgggcgggtaaactgtagagagaggtggggaaaacagcttagatgggttcacaaagctccccgggctcagctctggttctgacaccctcagacacggccagctgaccccagaagaaaggtaggtgttgggggtgcccatctctttgggaaatttgaaggaatcaaagaaggtggaggaggggaggtgacctggagcccggcatgtccttgtggccgggccacacccaggctggccccagggtgctgctgctgaagcccaatgggaacnacagatttcttttgagacacaaggaactcagaggttgtctcactcaccctgagtctgagcacctacttgtgccaggccctgtggggaaactgaggccctgggaggggaatgacttgccagggtcccgtgtcaggaggctgagcaggcagatcataggacttcacgtctctggccctcacctctgtccctctgttcagacctctgagctgatagagaagaaacaggctgtgctgtgtccctaatgggaaacatggctgagacaggggagtgagaaggtcgcattgcagaatggtacctgtggcatgatgccagctttgcaatcatgagattcaaaagccacactgtggaattgtgagtataastacaggagtgagagcttaggtctctgtgtttgtagaagcagaatcaaacctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttctgtgaaatatgagtcatggtcttatttgttcttcaccaaaaagagatgcccatcaagatagaaagaaaaattaaattcaatttctcaactgaaagtgaaactgaagctgggccatgtcatccagaggctggttgcttttagttcaagtaatgcctcctgcacctgggatttcagccaggctgtgccagggagggcggagggcatccrggtcagtcgtagggggtgcagctgggaacacaacagtgtccccattgaatgttcagagtctaaaggggagacagaggcccaaagagccacatacaggtagagctccctctggaaagcagagtgctcagggagcctggggagggttgggggccgccgcatggaccaggcagctttgggtgggtctctgaggacaggtgacttgcacatggtggggacagtgggggggacattccagggcgagggagcagctgagtgaaggcctgaggctggggatgggagtgggaggagtagatgggctccaggaggcaccgaagcagggcgtcagtgggtgcctggacctaaggtgactgtggtggcagggagcggtgaggaaggtggggnccagagcatcagagggcctgtgtgccctgctatggggtttgaacttgaccgtggcttttcactgaagattcctcagaagggtgcagtgccacggctgaggcctgtaattcagtgctgtgggaggcagaggcgggagaatcacatgatgctaggagctcaagacagcttgggcaacacaggagatgctgtctctctgaaatgaaaaattaacaaattagtcctgcatggtgccgtgtgcctgtagtcccagctacctggaaggctgaggcagnaggatcacttgagcccaggggctctaggctacagcaagctgtgatagccccaaagcactccagactgggtgacagagcaagacagtttctcaaaaataaaatgaaaatgacgatttctcaggaaatcatttcgactcctctttccctgcccaaggaggatgccccacaaccacttggagggagatgctttgctgagagtccctgtcctctgcatctggagagcttggctcagagctgaggtgggagggagggctcctcttccaggtcgctcagttggacaccggaattgaccagcctgcaggctcacccatggagtacacactgtgtcctagtcaagcctgaggggcagtatccagcctcaacccccagcagaggctccagacaaaggtgggagccaggccaacaatgacccaggaggatgggatcctggatgcagctcctcacaagtattgggcaggtccgaggccccagctctgtctgccctcctgctcctcttctccctcctggtcctcctggttctcatggctcatgagatggcrttgagacagctcccctggcctagggtgtcacagagtgaacaaagcaggaagaaggggaagggaagaccccctcccgtcaccccgtcccttacagcaagaagtgtccagatgcccctctgcatactcccctggtgaactgctgcccaggactgggtcccccttttagtcttgctgcgtaggggccccagaagacagatatctggatgcctcgaccctgaaacagaggtgggaagtggaaagagggaggcgagtggcttttgaggagggggcttttgtataagagctggaggatgcccgggaaccactgagctgttaaaataaagtctgcaaacaaagaccagctgctggaagtgggtgtgccggggagtgcgcagagacacaaggtgagaaaagaacaatggtgattttggagccgcccctaactgggatgggcctgaatcggtattatcattattacttatagtgtcattattagtcattttcatcttgtttgtacactccctctatctctcctctccaccttttcctaatattgtatcaccagttttatgtcctccattagcaactttgtagctgtaaacaatttacttacaactttctttcttatactctcagttttacctagtatttcttgactcccctctttaaaagatgacaatattaatcctccttctccttcgttcagtgcttcacatcccaactgctacctttgtgctttaagtttgtactaatcggtaacaagtatatttagttctcatatttatatgctctgttctgttctcaaagttaaaaatcaatcaagagtgtttacattttgtgatgttttaaatactatttactgtggagctgagttgtacaccatgtttgcacatgttttgtggcacagctttactttttcctgatgtttctaattgcctttgttttttttyctcccttgtactgcttgccttcttcatttcctcagtttctctcaaactgtgaatcctttgaggtattctattgagtccctttttcccacagaaccattccctttttattccatcctggactggtcgttttgtaggcctactgcmtgtcccactgtgatcctcagattcccttctctctgggttgattttcctgttttctggatcccatgtctttttctttcttggttatccccacctgccctccatggatgcacaacacatacacacacacacacacacacacacacacacacacmcacacacacaccctttcttcctcccggtggctcattctcaagtagctttcttagaacaccctgtgaccctgtgcctggtaacttttctattccccatatagctccttttcttctgtcatctttttggtttattttctggaggatttccgtgactttctttcacatggtctctctagacttgtttatttgatcatcaccttttagtttccagaaaatctcttttttttgtttgtttcattgatttttcttcttttctatatatcttgttttaagtttatgaataaaatattttttaatctccctgaggacatgggtttgagatttaaaaaattacttgtttgttctggactccttttgtatttggtcatcttggtctgtttccccactttcacctttctccaatttctgatcctagatctattcatattgaacggggtggggggcaggtctactggcagtcttccctgtagggtgattgaatgggaacccactgaagtgtcagaatacaaagatattatttctggggcatattgcttcagtcatgaactctctgatttttttcactggtgtagactcaaggctggcatgaatcccatatggcacgtgggcctggtgaactcctcccctctctgaggctctgcctagtagaccactctgcctggctggatgccctcttggcattgctgtggttcacagctcccttcacccctctttattcagttgtcatttcttcagccagttctgttttccaacatctcttggcatctctgatctcctgttgccctcatttaaattttcattggcagcagaggrtgcagaggcagtgcgtgagttcttgagtccgtctgtctggntgggaacccagtctttaccacgtagtagattctgagcttgggcaagtcactgaacatctgtttcagttttcttacctgaaaatggaaataccaatggtacacacttcctaggttcttggaagagttctgtgagttactatttataacatcttagagcaattagtggtgcaaaatccaccaatgtttgcccacattaacattaagtgccattatacctgtaagtgccttgactatggctgtagtttgatctcaggaggggaggttgataaatgctcttctgtcttcttaaaacagtgcctaaagatgattaatatgattaacatttgctattttccctcacctcccagggtaagataatcaggagcagaatgtgaagaactttcctctatataaagatcagcatttattcaggccgggtgtcgtggctcatgtttgtaatccagcactttagagggcagggtgggaggatcccctaaggccaggattttgccagcagcctgggctgcatactaggagtgagaccttgtctcaaggaataatgttttgttttgttttgttttcctgaagaaaagactactgagagccagtaagactgaaagaatggacatcttcatatcctgttagtttgagtgtgaatttgtacagttttcatacagagtggctctaggtataaaaacttttgagatgttaatagcttttgacctagtcattctactcttaaaagtatcttaaggaaataatctcaaatgtgagcagttttacgtgagggaggatattctttgtagcataatttatatgaagaattagaaacaccctaaggtccatcagctaggggaggacagcagaggggacggggaagcatcaggagggctcggcagccacagcaggggctgggccggcatctagcaggatccaggtctttgtgggacaaagaatcttagagaagcaacggggacacaggctgtccactgcagcaccagtgagttcaccaagacgaagagttgagcacagagtgtgagacagggatttgcaatgaggagtcatttaccatgagcgtgtatacatgactcaatattgtatatttaagggagtagagcacagtaattgaagacatgggattgaagcagaagtcctggctctagcactattgtgaaaacacccataagttccctaacttttgtggattcctctgtgttcaaatgggaaagtggtacccatctcctgtcctgtgtgtgatcatcgaatgagatacatgtcagaggccatgcacatcacagacacacaatacacactggctatcatcaactagttatcakacatgttcccaggcccaggtcattgtcagaatgttccctcccatctctattcctgtgtatagactctgtagtttctgtaatgatcagatggctgcccctcctctgattatctycttctcatacccctacaggacaagaggaccctgccttggtgtgagagtgagggwagaggaagctggaacgaggtgagtttctgtaaatactagctggcagggccccaggagataaacactctggacatttgctgctaccacagagggatctgcaaagacccagcccctccagcctccctctgtacacaggaggctcaccttcgatcccacaatttgttttctcgttctcaagggttaaggaaaaccttccagtctggacagtgactggagagctccaaggaaagcccctcggtaacccagccgctggcaccatgaacccaggtaggctcgcttcctctttcctggctagttcctactcgcacctagaatggagggtggcacctccacagctgagtgagccccagaagaacccagatggactaggaggccaatgagtctgcccygagcagcagaagaggtcacgtggagtcccccgacccaggggtctgggggtcatctgcatcctgacctctcctcggggtgacacrgcccaggtgcccacttcctccctaccctgtcacccagcagatgactcaagtggggcaggacagccatgaggaagtggaacaagcargagaggggagtgggggaagagcagggtccaggaggaggggaggggtgggagaggaggttgacctgcagccctgatctcttatctaccgctcttctccctgctgacccagggttttttccagcacaggccggtcccctccctccagctcttgccctgcaccagcccctctgttctgagtggccctatgggaatgtatcatgcttgacccagcttccaacttaaatggaccccggtctggccttttccaagtcccttctgtgtgacctggagctccttacctcccctctcgtgtaccatgaaaataatatttccccatgttgtcacgaagatcaaatattataagggtacctggcctggccaaagcctgccacacagtagggcctccctaagaattagtttgcatcccctctatctcctctatctatcccctgttgattccaggtggaagccacccagtcccctcatctgtgttagggcacccgccctgcactgcccatcacaagcacctgctgaccagggatgactgcctcaggcagggcctcattcccatgatctcagataccccttgtcaaagaaaaatctgaggcacagtaacatttatttgaataagaaggaattcatgaattgagaaaaccaaactggaagaggcttcatgttatgatgaaaaagtgtcagagacaagtatttatcgagtaaatatgaaactgcaataaggacattatttgattggttgcagttacaaaactgcctgttttgatttacctttttggaaaattcctggtcacattggtgctggtgggtttaggaagttctccgaatccaggagagaccagaccttagccttgtccaggtttttgactccactgagagaaaaaatttgagtcaaagaaaaaacaaatcagctgcaaagcagaagcacaggctcagggatggaagtgcaggtggactcagaagagccagttgggcccagtggggtttggggtttctgtctttgatggtttattaaattaaggggttggagccttgggaggactctcttgctggcttgcggcagctgcctttgcgctgtgtgcttacctggccttattgtttctctttctcttcttacaataggacactagccctctagtaggattagagccctacccttgtgatctcattcagtcttaattgyttccttaaaggcccaatcttcaaatatagtcactcgagtttagggcttcagcatatgaattttgggggcacacaatccctctatagcactgatgactccatcaaacatgtcccacatcacagttgtccaggaaaaattaacatgtaaccacctaatgtgcaatggctgttatgctcccctacactatcctccaaccttatcctttcttctttccaactagagagcagtatctttattgaggattaccttaagtatttccaggaccaagtgagcagagagaatctgctacaactgctgactgatgatgaagcctggaatggattcgtggctgctgctgaactgcccaggtaagytccatggggttaactccatggggcgccccagcgatgccactcagatctcccctgggctggttgtccctgacaggcacacctcctccaggcagccccctctgctgggcttgaggatgaccttctcggcactccaggaggaatatttcctccatgtccttcgctggcagtgagtagcctcaggctgaggggataggaagcccacaggaacagggtcatttctgccatctgctggtgatgggaactttgccagttactttctcactttcagcctttcttcatcaatggagttttattatgagaaaaatgagatcatgcatgtaaagtgcttagcataatgactgacacatagtaggtgcacagttaacgttaacatcttacaagcttggtggaaagagaccagggttaaggatcttcttcttgaagacgggagcccagcaggacttcctttgggaaaagtcagaaaaatcctaacctaaacaatatgtgttcctggggatgctggctggggccttttttctcatctgaagaattccacaaacacagcaggacccttctgctggtccaggatcctgagaggcctagttcctgggctctgggcttatgtcatggagacttggaactgtcttctgtccaataggaatagcaattcaatgtcataggagtgtggtgaaggccttagaggcaactccaggtcaaaggtggggaaccaaggactaagatcctgctcaaaggcccagagagaccgggaccagtgtcagagcctggagtcaggatggagtaagagtcagccttggtttggtaggacaagcaggaaggctggggcacaagggctgggactagggtgtggaaagagaggcaccaagggcttgaaacttaaggaggtcatgaacttgcagaggacatgtgagtgggagagggatatttcttccctgtctggatgatcccaacactcatgggcatacagggtcatggtagcctgtgtctctcaccccatgccttggaactggtgagttctggactaccctttcagaccttcttctcttctacacagagaagctccttaccatggcatgccttagtgaccatttccaaagtagaatgaattgctgccaatttgtgtaatttcaggggtactgagcagactcacaaagtcccaaccgaggaggaaaacacttcctctaccatcttgaccaaattcaggtcttttcagcattagcaatttatatagatggttctgaaagtgtcttgagtcttctagtggttccataaaattgcacatggccttgctgtgcacacaggtgaagctgtcactgctaaggcatcagttaggctggtgacacctgcgagtgagacctggaaggttgggggtgcaggtggtaggtcaggaggcagtaaggtggctggagcgtccatgtggagccagaatgaatagccagatctcccactccagtcagctggggcagtggccagacccagtagccttcagccaggtgaaagggcatgaggcattggaagggagcagatgccaggcaaagtgatctcctgtctttctgaggttttgtttttgtttgaattcaaagtactcagagatagccagactgcaatgtctgagggcacccttacctttgacaccacctgcaaatctatggggattcctaaaatcatccttagattttataattcactagaaggactcacgtaactcactgaaaactgctattgcacgattgtggtttatcacagggaaagaacacagattaaaatcagcctaaggaagagacacacagggcagagtctgggaggatttcaggtgtgaatcttcattgtcctcaggaggctgtgttctcctgtgtgaatgtgggacaaaacacatgcrgtgttgccaaccagggaagctcacccagttaaggaaaaattcctgtgaatcacattaaaccagaaatgaagcctttattcaggattgttgttacaggggagggagactgagcccagctccaaatatagtaaagacagagggggagtcacagccaacaccagggtgggggcgggagatggaacaggactgacaggagacgccagagtggggggttcctgctaaactggcctaacaggattctcgccaaaggcaggtcagaccctcaaccaccagtggtgggggtgaggagcatgatcagataacaaacggtgctcagacagcaagcggggaggaccctccctaaactgatttggggagattcttgctgagccaaggtggtgcaagtccagaaagcagtgggtgagtgtggaaggccaaggtcggcgcctagtggagaagaagctctgaagagcccagctggagttggtcaaggagaaagtccttctttctcaacccatgccttagtgtccagagtatctgctggggctggatcacaagctgccctcatggctagagtctccagcccttccctgagatctcacacctttagtccccaagtcctctggaagtcaggaaagacaccaaatagccccaaaccctatcatccatcacatcgctatactgtcccgtggccaaatcaccaggcaaagaaagatgttcctaccaggcaggacattccaggggcctggagatcacttcccaggagctgaggacaaagggaaggcctctctttgggtaaagttcatgcttcactttcctgccatcctggtaataaggtctctttgtctcactctcactgctctttgttcatctgcagagttttccctctccaaacactttggcagtcacggtgttgacctgcccttgagtgaggaggcatctttatcaaacacctaccatgaaagagcatctgaggtgcctttaagatatttatttccatatggaataagtactgaggaatatctatgatgaacaaaatgtgtttgagtttgaaagataattaattccatttgtaaaatttgtttctatttgattgatagtgaaagctctgcaatttacacaggatagagatcgcatggagctcatttcacagatagggaaactgcatttcttaatcctttaacctttccttgtgcagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagccngcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatytcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagactttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagnggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactacngacccscccccaggtttgatgtccttccaagaataaagtctttccctggtgatggtctctcgctctgtctttccagcatccactctcccttgtccttctgggggtgtatcacagtcagccagtggcttcttcatgatggtggttggggtggttgtcatgtgacgggtcccctccaggttactaaagggtgcatgtcccctgcttgaaccctgagaggcaggtggtaggccatggccacaatccccagctgaggagcaggtgtccctgagaacccaaacttcccagagagtatctgagaaccaaccaatgaaaacagtcccatcgctcttagccggtaagtaaacagtcagaagattagcatgaaagcagtttagcattgggaggaagcacagatctctagagctgtcctgtcgctgcccaggattgacctgtgtgtaagtcccaataaactcacctactcaccaagctggacttgttcgagtcattctttggtctctcagctccttctaagctttgggggccatcagtctcaagtttttctcgtaatggtggtgatggtggttgtgatggcagcagagtggtgggggccttggcaagtggtcggtgctcttccagaccaggggacaccgatggaccgatgaagttccaggggaacttgaagtgctgtgttggaaagaggttaatttgggaagaaaggaaaaatgaaaggagatgccaggaacaggtcaaggaagcttgaggtgtgtccaggagttcaaccctgcttgtggtcatgagacttcacccctctgagcctcagtttcctcatcagctgtagaagggggctggaaaaggtgatatctcaggtccaccttgctctccccatcttgtgttctggagacttgagtcaatcagcactgactgatggctgtgactttgtggtgccgatggaggctcccctgggctctgggtgcctgacttaaccttcctcatgatccttcttccagggtctcagggagcgaagtttcaaggccccttctgctcgctcactggactctcactttcccagctggtcatttccctgagacctcaaaaccccaagcccattggggcactcggggaaagctggtacatgtctggctctggctgagcacaggtgtggtttccatctgtgagtcagagcccgggattgacacgggacactcgaggctaactagtgtcagaggggcctgtgtgcagattgggagaggatcagcgaaaaatagagggacaaagagagacatccagacagcaaacactcccatccagtctgtcctcacgttttgcccagactcctgcaagaacttccagaatggtcttctctgtgcccctgcccctgtccctcccatgtcctggaccatgctccacactgggccaggttgggctttaacaatatagtttctttttttttttcagatactctcactctgttgcaaggctggcaaaccatggcacaatcatggctcaccacatcttggacctcccggcctcaaactatccttccaccttgactccctgagcaattgggaccatccgtgtgtaccccaatgcctcgttaatttttgtatttttttttttttttgtagagacagggtttccctatcttgcccaggctggtctcaaactcctgagctcaggtgatctgttcaccctggccttccaatggactgcaattgcaggcatgagccaccatgcccacctaagaacataggtttgattgagcacctgcttccaaccctctaatggcttcccattactcttagcacaaagatgtaggccatgatgctgcctaaagtagcctgttgtggcctggggtcctgtgaaggaagagccaggggcaacgttctggtgtagagggtttgtgtgggaagtgattctaggagcagaactgaggatccaggagggaaggaggaaaagttgatacaaggagaagtttttgaatgggtcatccatatgggcaatgagaccttccgaggtgccttcaagaagcgtcctcagaatctttgtctccagggaggagagagggaggcctttatccatggcctttatccccatgggcttgcctcaggctgaacttccagccaaatcttcagctgttacctaagaaacaatgcagatcctggcccgaggacgccgccccttccaggcagcctggactgtgaggtgtgctccattgctcttcaggaatcatccttgagagttgttccacagcagtccaggtctggctggagcaggtggattgggcggaaagtgcagcagaatttgagagaggcctgttcttacagtgatgactcactgtaagcacctgaattcagccctcatggtcttttcactgctgttagtcattcatctctatgtagtttttgcaaactagaggtagatgtctgctttctacaatcaaagatgtcagcatttagggcccagggatggaacaaagttgtttcatgggagagaacagcatccattctcctcttcctagttcaggaggtctgggttaacaatctgcagcttccaagaatacgcactccagtgatccacccaggaactgaaaacatgatgaccaggtgaggggaggttcctaatggactcactgaaagctaaactgaaatcaggtattcactgattacttgtccccctgtaatctcctcctctgaccggaaggccacagtggcactctgagttattatgggtcccaggagttggtgtcagtgtagccaggatccagaagtcctggggatgagtttcctttaagccgtcccctgtgatctgagaggacgctccaggtccagggagaacaggtaggaggaacgcttacaggctgcacttaaggggaatgacagggcctttcgcagactcctgacctccctttccttcaagggctctgggtctgtcctatgagtcaggcctgagaattgggtgacaagcaggggccatccagcatgatgacctgtgacaggtgtctgcccaccaagttggtggttgtgcaaagtcagtggactctccgccggctctattttgggaccgtgtgcctgtggaatttccctgagccgtgatcatgtgcactccctgctgcctgacctggtgcccacactctcttttcttctggccatgacctgcctccgcaggagttggcctcttggaatttctcccaccctaaagataccaaggtcccagcccstcccccattccagagagttcctggttatccattgattcttctcaccaaaggaaagagaaatctcctgggccctcacaggatgcagtgtgggcaggaaggacctgagaaatccaatctaaccttccaatctcctatgcacgttgagtcctccttcttctttgtcataccaagtcatttctgaatttttggcgtcacaacgaagtggccagcatttacttgagggtggctcatccagccctgggcacagctggcatcccagcctgctgctggagcaaaccatgccagctgaggacaactatggcaaggaacccaaatgatgtttccccttccttgccgacctttctcggactccaccgcacaaatggtctccagctctttggagtttgatggtgggctccttctcctgctgcagcgtctcactcctttccattctgcagttcactctcatgccacactgacttgaacattggctgtctagaaactcatggggggcaggggcaacagagatggagcagcttcctccatcaggggctgcaccttggaagcgtccttagatgtggcttggagttgggattcttcaatccccctccgacatccctattgcaattttctggatatatcttgtattaggctgaataacagccccccacggatgtgcgcatccgaatgctggaactcgtgattatgtcaccttccatcataaaaggcaccttgcaagtgtgatccagccaaggatctggagatgggaggttatctggaattatctgggttgggcccaaggtatccacaagggtccttataaggcagaggcagtaaggtgacagggagaaaaggagatgtgatgatggaaggggagagagactgagagagatcagaggacactacaaggctggctttgaagatgaagggaggagccaggagccaaggccagcaggtgtctctaaaagctggaaaaggcaatggaatggcttctccaggagcctctagaagaaacacagccatgcccacaccttgattttaggacttctgacctccagaactggaagagaacaactttgtgttggtttaagtgaacacaaagaaaaaatggattaccaggaactctctgaaattggggaggggctgggaccctggtctctttaggagaaattctaagaggccaactctgggagaggcaggttatggccagaagaaaagagagcgtgggcaccaggtcagtggtgctttgttacagcaggggaggaactaatacaccactctccccatcagggccctcagctgcacttagaagatctggctaggatgaaatttatcatgcaaccagaaacctacagaatcagtctctgaattttattctcataggaggagagtcagccaacaacatcgacagccacaatttatttgatgccttcaggaaacatttcaaagccagatgtttgtttgaagtgtaggtcctgcttcaggtcccagcgttccttgtctcagccacgttccaccaggtggcagcaggtgctatgctggtcggcgtggggagtttcactgttgttccccctccctctcagcctgaacgctaattccacaaataccaaccatcctgagggtctgttatctgcaaccaactggttggtatcattttttttttaaatcagtcaagatcctttggatgcaagcagcacacagcaaagcaaaaccaagacaaaagcaaatgcaagaacaaaaacaaattagacttaaacatcctctgaccaactgaagagtagaggtatgtattggaatgatccagagagaaaggacacagaattaaagatttcaaaaaagcagaaaccttttctctgtgatggacagaagactcagtttcccaaagaataagacatcatatagacaacatgaggccaactgaatctgtttctctctctcatttctttctcttttatagtttgctcaacaggcaaacaaaactcttccatcatgttttgatattacacaaaaatcttgttcaaaagagaaaaactaaatgttacctttgtattaatggattagtaatgctgaagctcattttatacaatcctataaacaaatctatcaaattttaattagtttgatcatgaggtaaaatttccataaatcttttatagcttttaagattttctgttaaagagcagatcaatataccgagtattccctattactctgacacagaggttcagaggctggcccagcatccatgtgctatttatgttcatgttcaatttatagaaaaactaaatgatttcttttaaattttagccaaacttcatcacacatggtttcttttatgagatcaatcttccacaaacctactacaatttgcttaaaatttcttttttgccatatctttcttttaacttgaaatgatccttaaaacctctaaactaaacaaaatgatgttttcttaaaaagaaccacagtcccatgccctctttcaacccttttatcaaaacacatcctatctctttaatacattcattagtcagagttctccagagtgacatggtcaatagaatacatgtacacacagaaatacacatagaagtgagtttattagggagaactggctcacatgattacgagcagaaatcccacaacaggctctcggcaagctggggaaagacagaagcccgtagtgtgactcagtccaagtctaaaagcctcaaaaccagagaagccgactgcgtaggtctcggtcttaggatgaagccctgtaatcctccaggaggccgctggtgcaagtcccagagtccaaaggccaaagaccaggaagtctgatgtccaagggcaggaggagaggaaggaagcatccagcacgggaagacagagagagtgatgagcaagctgctcacccttttctcttctgcttgctttgttctggcctcactggcagctgatgggatggtactgcccacattcagggtgtgtcttcttctcttagttcacggacccaaatgtcaatctcctttgacaacaccctcacagacacgcccagaaacaatcctttaccagccatctaggcattcctccgtctagtgatgttcacacctcatattaaccatcacaatacactttgtgtatagccagaaggtggtctaggcagcaatagatgtaatgttttaattacatacattaattgtaatgtgaactcttggtaactcttatttttattgaagaatctaggaggtaaacagttttaattatgcaccagatgcatatcccaggatgaagggcaatgcc

SEQ ID NO: 10760 - DNA, 32521 bp, Homo sapiens
  misc_feature (1)...(32521): n = A,T,C or G, or insertion/deletion polymorphism (see Tables 1-2)
gaacttgaacttgtgtctgtctggctccaaaacaactccattcatgcttgaagtgccatgattgttcaaggaatggtcttgttgctattgttattaagaagttgaacagcccagcattgaagtgagcaaagaaagtcggttggcttcacatgccttctaagaaagactgataaaggctaaaggcgagtggggcagaaactagggtgcctcattcctgtgtttccctccatctcctcctcccatcaggtcctcaataaagcctggcagcctggatttgtgctgaaagcccctggagcaggcagaggtacctgctattcagcatgctttgggccttcctctcccttccctatctgctcattcctcagtttccacaccagtaaaatgggaatcatcagagtaagtgcctcatagggttgttgtgaggattccagagggtaaaccaaggagtgctctcagcactatggctggcacagatagtgcttaacaaagttgttattattattattattttgagacggtgtctcgctctgttgcccaggctggagtgcagtggcacaatctcctctcactgcaacctccacctcccaggttcaagtgattctcttgcctcagcctcccgagtagctgggattacaggtgcatgccaccacgcctggctaatttttgtatatttagtagagacagggtttcaccatgttggtcaggctggtctccaactcctgaccttgggatccacccacctcagcctcccaaagtgctgggattacaggcataagccactgtgccctgtcattattattatttttgttgttgttgttgtttttgagatggagtctcgctcttgttgcctaggctggagtgcagtagcatgatctcaggtcactacaatgtctgcctccagggttcaagccattctcctgcctcagcctcctgagtagctgggactacagatgcccgcaaccatgccccgctaattttttttttagtagagacagggtttcactgtgttaggatggtctcgatctcctgacctcgtgatctgcccgcctcagcctcccaaagtgctgggattacaggcatgagccactgcgcccggccaataattttttttttttttaaagagaaatacacatatgtagaaaaagaccagaaggaaatgttggcagcgctcgactcttggtggtgaaattacagatctttatttaatttttcttctttgtgcttttgtgtatctcctacattttccacaatgcacatagcacttttacaatcagggagtaacaacaaaaaatgcaatgtaaatcctgagaggagctatcacctgcatttgggctcttccggggatggtccaggggaagtggattttagcacagcctggaaggttgggagaatgtgaactagggagaggagccaggtaaagccttttttgttccttggtttttgtctgtctcctctagactacgggttccttgagggcaggatctgtggtctggcttgttcactgctgtatccctagcatcttacaaaacaaaagcctggtgcttagtaggtgatcaataaatacaaatctagttaatgaatacatgaccttsacagctctgcttagcctaggagacaaggatattctcagttcgctgtccagctggtctgctgccaaaactgaggtgcatggtttccatggcaacagaagagggcccgacaggccagcagcaggaggcagatgcagggattgtgagctctgcatgttttcaaggtgtggcctagaaatccggaacatggcggtgggttctttcaatagatgttgagagaaaaaaagcttcataaatacggctaactcagttgttcaccaggcaggtttctaagtcaattaatgaaaactcgggcaagtagtcgaggtctttaaaggtgacatgggaggctcttagtgtttgaaagtctaggaactcaggaaagtttggttttagtctggatcctgactaagggtgtgaccctgggcaagttacttaacctctctgggcctcagcatgctcattcataaaatgagaggtttgaccagcactaaaattatttataaaaacatgtgtggtaggaatgcaaaatggtacagtcactgtggaagagtttggtggttcctcagtaagttatacatagaaccatcatatgacccagcaattccactcctaggtatacacccaagagaactgaagataggcactcaaatacatacttgtgcacaaatgttcatagttgcactatccataataaccaaaaggccaccaatggatgaatggataaaggtagtatatccatacaatggtgtatcattcagccagtcataaaaaggaacaaagtatttatacatgctacaacatgaatgaaccttgaaaacattacgttaagtgaaacaagccagactcaaaaggtcacatacagtattgtataattccaactaaataaaatatccaggctgggcatggtggcttacgtctgtaatcccagcaccttgggaggctgaggtggacaaatcacctgaggtcaggagttcgagaccagtctggccaacatggcgaaaccccatctctactaaaaatacaacaattagccgggcacggtggcatgcgcctgtaatcccagctacttggaagactgaggcaagagaaccgcttgaacccaggaggtagagattgcagtgagccaagatcgcgccactgcactccagcctgggtgacagagacttcgtctcaaaaaataaataaataaaaaaaatatccagaataggtaaatccatagagacagaatgcagattggtggttgccaggggatgaagggagaagggaatggaaagtgacttcttaacgtgtacggagttttcttttggggtgataaaaatgttttgcaactggacagacgtgctggttgcacaacattgtgaatgtactaggtgctagtgaatgatacattttaaaattgttaattttatgtcagttgaatgttacctaaaaaaaaaaaaaaaagacatgttctgcaagcatgccttaagttacataatggattcctaggagcctgagagatgggcaagactgagagtaatggatgaagtagagaggttactcccacccccacaatcacactgccaaggcgacatttggaaaaaagctcccaggtgggatcagaacggcgtctggactgtctctggccacttccccaaggtgggatcctggaccactctggctccttgaacctcaggcttcctatctgcaaaacagggctgatgcacgttccctgttttcctcagagcaccaccttctgaacccaccttcaccgggtgaatccgctggaatggggccagtcatggcaccttgttttctaagcatagcagacagagagtcagttcctggttcaagtggagccatggacgggtgacaggtttcagaagccactggtgagaaaggggcagttaaccagtttgaatcctggctccatcactatctgtgtggccttgggcaggtcactcaccttccccagttccaatggttgaataggaatatctgtacctactatggagaaacgatgtgtgtatacactggacgctcagagcaaacctctttttcttttctttcttcttcttttttttttttttgaaacagttttgctcttgttgcccaggctagagtgcaatggcgcgatctcggctcaccgcaactccgcctcccgggttcaagtgattctcctgcctcagcctccccagtagctcggattataggcatgtgccaccacgcccggctaattttgtattttttttttttttgagacggagtttcgctcttgttgcccaggctgtagtgcaatggcacgatctcggctcacggcaacctccgcctcccaggttcaagcgattctcctgcctcagcctctctagtagctgagattacaggcatgtgccaccacgcccggctaattttgtatttttagtagagacggggtttctccatgttggtcaggctggtctagaactcccgacctcaggtgatccgcctgcctcgacctcccaaagtgctgggattacaggcatgagccactgcgcccggcctagttttgtatttttagtagagatggggtttctccgtgttggtcagactggtctcgaactcccgacctcaggtgatccgcccgcctcagcctcccaaagtgctgggataacaggcgtgagccaccgcgcccggcccctttctctttctctgtggatgttcccagcagctctctcaaaaataaaacgtgccagttcccaaaatccgcccaagaaagctgtggctcagagagggaggcactagcctaaggtgacagtgagtctgggcttagaacacagatctcctggcttcgtgtccagggaactttcttcatgcctctaattcattctctccaacaggagtttggcatgtactatgccctagagcggaggtgtgcaggacaggtgctgctgtccctgtgcacaggttaagaaacagtttaactgaatctcagggaggccaagtgactaagcaccaggacacgaaaccagaaggcagaggtctcgattttgaactcggatcatccgccagggcaacgcccggaagcctcagggcgcgcgtggctgggcgcgagctcggcgcgcagcggtgggaatcccgagcggagttggaagccgggcccgttcatttgcatgctaatacccagaatgcttttcccccgcacaccgcttctcttaatggaagcgctcagtttggaaccgtggaaagtttggaacacatacttcgctgcctctttgcaactgtgggaacttcccgcccgcacacgcggcgcctgcagcctggggctccgcgccaggcggcccaaaggcagccgccagcgcttcctgggaagacaaaccttggtgtacaactctagcgtggtagcatccccgggcgggccggggacaaagcgccgaggcctggcggcagggcccattaccagagcacccggcgtctcacagggctgcgggcgctggggatgctccgggcttggagaggcctgagggtgtccccgactcctccggcacccccacttccctgaggattgctggggcttccgggggtccctgccccgtccatcgccctcatattgtcgcctcccggagctggtgacttcacgctccccggggacaaagctcggcgtrctgtggtttgggggagaagctggacgctggcttcatctctccagctcttccgggcgcgcagcccatcagatcgatcaatgtaccgggtgcagaagcagctccggaggttcggcctgtctccggccaggaccccgggccctctctggtgtttgaagcagggaggcggtcgcaggcgacttctgggaatttcacgcatgaaagcggggctccgaagggtggacgacgcccgctcgacctgcgagtgcgcttcgcaggctggggggcccggatccgcacccctcagttcctgcccccccaccctgctagccgccactctcagcgggcaggggaggggcagtgggagctggtttgctggctcggcgcttcgtttgcattggtccgggggggctgagactgcagcccccggccccgcgggcggggtggggaggcgggggccggacgggggctcaggctgctctagcattggcggatctggggaatggggagggggggcaggaagcggggggagcggagctgcggggggggggtgtataaatagggaaggggggacgtgcatcctcgtcttggtgaggggggggcgctcggcacaaagaaagtgtaaagtttgcagcgccaggcggcccgggctaggcatccgggcgcgcacgtgcaaggccggggacgccgggggcccccactctgagctcgccgtttcttttttttctgcaagcgagagggggggtgttgttggtatcgccccctccttctcctccccccaggggtgaaagtgcaagaggaagtgcagccgctgccatctttcctccgctccgaacacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctytttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggtgaggaaaggccccctcttcctcccctgccacacgttatcttagtcctgaaaaggctcctgccaagatctgggggtgtgggatttgtgggggtcatttgaccttatagaaccatgccaggtttgggtagagtgtttttaagggcccttattttgagatggtatgcctgaracctgctttccattccctcagggaagtttttttgacgctaagtgtgccctactgtctctcctcctggggccggattcctcaggccagagccaccggacctcaccattcttcccccagggctccctttgtgtttccggcaccaggcgtggggccccctctgggggcgggagactgggctcctccagcgacttccccgcttgaatggctgccgagggaggtactggaacaagtgcatctgggactccctacactcttgaggcaccagattccccaacacagaacactggccatcctgatcagtagactccagctgtgcctctcacaccaccctgggatcatgggacacagagctggtcacccagagctgctgcttaacaccaaaagctttgatctgctctgacctggtagctctagagcctaatgggacccacgagcccctttatgttttcaggacagaaaggaatggggacaggatctctatgtaggttcactttctagttagcctgttggggaactgaggacttgtctgggagcagagggtgattttgtttttctcctaaaaggccggttttaacctggattgtaggaccttgtgtgtgtgaacacagggatggagaactccctcagagggccccgaccaggaaccagtcttaccggtcaggcagcccctgcccacctgctcaggcgggcatctggcttaccagcccagctggggacttaaggctccactgctggcctctggggactgaattccatccgggtggcattcattggctgcccgtggcgggagaggctgggggaggggattgctgagtttctaaggggctttagtctggacaatgaatcacatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctccagagaaaaccagggcagagaggcctgggcctgtggagccagaactgggtggtgactttgtctttgtcatgctggggttggggagagggagtcctttccagcagtgagtgtgtgtgtgtgtgtacacacgtatgcatatgtgcctgtgtggtggggtctggccaagtttctaaagtccctcttggttctctcttttccaggcctgatcacttgaacggacatatcaagcaggtgcacacttctgagcggcctcacaagtgtcaggtaggggctgggtcagggcagagatgggctgaaggagatgatgctgttctcacggtcgcagccttgagccagccgctgcgtgtgccgggggcccggctgaccgcccaccgctttgcacacctcccctctgttcctccaccctccctctgctctcctcctttgttcttcccccaggcccccttcccccacagctgacgktcctccttcctggttgcttggtcctggttcccaccctgtctttgccttcactctgttgcttggctttcctctcctggtgtttgccggctccttggatggtgggccgtatcacacagatgttgtgttgggagacccggcactgcgctgggcctgactgttggtttccagcagtttgtagggactgcaggtttttttaaaagggctcctggtggtccagccaaccactcttccccttttctgacctcagttagagctcctcctgggtcccctcagcttagggcacaaggcagtgggggaggtaggaggtagggagtgggtggtcccctctcccacactggcatctgtttaacccatcctaagccagggtttctggaggactggagagcaaagtgggctcttcttcttttagctctttgcaaagtagcaggtaggaaacgctggaccagatagattctcacccttggtttacctgcttgaacaatatctgggggccctgctggtacccaaaagattgagtttcctctcctggccactgagccttcctgtgtggatagcgaacacacctctgtcttctccttggttatctcccctctcccatgccaagttcccatcaagtgagggcgagccatgattgtggggtgtgcactgcagtctctgataggataacctgcttctccttatcctgttggtggcaaggggagagggttcagggagaccagcagggagggatgaatgtgccgtaagtagggcagagcccctgggggtcaggcgtggacggtgttcacaggtgctgggctaggcagtctccctggaggatgacccagggtgggcctgctgggatctgtctttgccttgctgccttctctctctctgtctctgattctctcatcacagagcacattctgactcaggtagtgtgctgattagcccgggcagagtaggaggagcccagagggcagtgggggcaagcccggtggcctgggggggtaacctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacatttgaggctttgtgtgttttgtccttggtctgtgtcataacactgacatcactgtcccttggtgtacaaatgcgctcctgccctgcccctcccaacatacactctcacagacctgctggcccctcctccagccctacagccacaactcccctaacggacccagcaggtgaagacatgctggctctcttgctctgggctggccagccaggtgtgcctggacttggttaaacagcaggggcacctgttggcatagtgtggggatgctgaaaacataagaggtgaagagacggctctctgggagttcattccttgagttccccactggctaggcacagtccgtatcgctcatcccctcctgatgccagagagaatgaaagaggccagttacagagactagtgccatagcttaagtagaaaggccatctgaatgtaggggcaggaagcctcaggcttgacagtggcatgtctctttgggacttggcctgagtgtccttaactggcccagatgccccaggtactgctggatttatgagcttagtgggctgggacatttcccccacatggagttcaacctgaagctgagaggctggagcagctcagacctccctagcttccacgggctccacttcttgggggctggttagagaaggaatgcgttgagatgggcatatgctcgagaagaagggggccaaagagcccagggagctgaaccttcatgcattgcccttagagttttccagggctgtgggagaaagctgcttgagactacccctgaggctgcctgagttcaagggctactaagggtgggggtgtgcactagtgcccttggtaccacttgggccccattcccaagctgctcaatccttaggaagaaaagctttaggaagtctgggaagggagcaggactggggctcagtgttgagtggtgatgacctgcactcagggtgcctgggccaggacctggcaggcatggcccttaattacagcaggctgtctaactaagcacagggctgtgggccgggcagctcttccgagtgccacaggcagtcaaagcattctgcctctggctcactctcttcccatcagcgtccctctgtcttctccctgtctctaggacaaagaatgctcttctcctgacaccccagcatggaagttctggatgttccctttgagatctgtctccctccgccccttctctcctgggttgtgtgaccaggctctttcatgttctgtgttgtctgaacttctgctgtgcctagactttggactttcacaggctccccagaaaacctggggactgcagcagcagagggtcaatcctggcacagagaagccaacaatcacttcagcttggctttgaacacagggaaagcgtttgtcatgtttgtgttttttcccccagcagcagatttacattcctaattctgtttgctcaggcgaaagttagctttcattccttgagagataatcaatggaggacagggtgggggaagccagcccagtctgggattttaattttgcttagctaatccccaaatggataagccacttgtgggtaactgaagtttggctatccatcatctttaggtagcaaagcatgacaggcaaagcctttagaggacagatcccaaaagaaggttggcaagagaaacaaggcatctctttcctatccctcttgtggctccctctcccagagactgtggaagacaaaatcctgaatatgctttcagcccccgagtagctgggactacaggcgcccaccaccatgcccagctaatttttttgtatttttagtagagacggggtttcaccatattggccaggctggtctcaaacttctgacattgtgatccacccgcctcggcctcccaaagtgttgggattacaggtgtgagccactgcgcctggcctcagccctgttttcttacacctgatccatgttggttcctttgagttctgaggcttagaacacaccctctctcaccattggaggggtggtctttgggtcgctgcctggcaaagctagctcttgtccccaaataaatcaacaggtgtacctctctttcccgggggtgtttatgcagcccctgctctggtttagagactgctgggctgtgtagaggttaggagtttttttctcctactgtggcctgtcactgggtcatgaggtccctggctgacgtggggcccacatgtggccatgagagcaagcatccatggtgctttctgacttcctacatgctggaatttccttgcacaaatctgttcacctttcccttttgggagtcctggctgccaagtactgtacactgtgttataaagtatgagcacctttcactcagcagaagctccctctcctgaatctggagatggtaagagcacaggctctgggactggttcttagtccagctgtctcatatcctctcacggcctccactggcccagctgtaaactgggagagatcagaatcccccagggtgtccaggaggattggtaaagtactggcctgggtgtggtgggggtgggtgtgctagactttctttagtagctgagtcttgtgttttaagcaagttcaccttctgaaggtttcctcatttatgatatgaatacactgaatatataaaacagataaaagcagtatgtcattgctacaaattcagttcaaatgtataatgtttacttaaaaagacaatgacagaagagctaggtaggctgtgctaacgtacacagatatttgggactggggtagtaaacagtggtgtcttctaccttgacagcattgcatgcgtttgtttcttgctatggctgtacagtaaggagacagttagatgtctgtatgtgttgacagtgttcagccacttaccttgagctctcaggttctcaggatgtgcttctgttaaagagagatggcagaggcagttccgttctagcacaaggtaatggggtggtcttcagtgggttaccatttgatctgtgacacaaaggtgaatgttgctttctcttacagttctaaaacagtaaacacacacacacacaaaagaaatgagtcaaaattgactagaacccatgaaacacctccctggaaccaaaatagcttgaaagccaayggattcagctcttctcagggctttcccaatattctatgacccccacagctggaatgcctttgtaagctccagctgaggaagggatgttgtgaggagactgatcactggtactaagtcaggtgctcaggtacaggaagtgcctgccaacctgagtcctccttccagggtgctggttctgaccttcagctcctgactcatccaaccccgggggcctggctgtgagttggtgctcagctcacaccacagctttccaaagccacgctgtcttggagggtgatcacacagcttgcctcggagggctgctgtcaggatgggttgcatgagataagtgcctctaaaaggctgagcaccgtgcctgcctggcacacaatgaatgcttaatcaatacagggtagtatcatcatccttgctgtcaccagcacttccccagcttaacgtttcacaaatgctttttttttttgagacggagtcttgctctgttgcccaggctggagtgcagtggtgtgatctcggctcactgcaagctctgcctcccgggtttatgccattctcccgcctcagcctcccgagtagctgggactacaggcacctgccaccatgcctggttaatttttttgtgtttttagtagagaccgagtttcaccgtgttagccaggatggtcttgatctcctgacttcgtgatccgcccgcctcagcctcccaaagtgctgggattacaggtgtgagccaccgcgcccggatttttttttttttttttttttttgagaggaagtcttgacttgttgcccaggctggagtgcagtgacacgatcttggctcactgcaacctctacctcccaggttcaagtgattctcctgcctcagcctcccaagtagctgggattacgggagtctgccaccacacccggctaattttttatatttttaatagagatggggtttcaccatgttggccaggctggtcttgaactcctgacctcaggtgatccacccatctcggcctcccaaagcgctgggattacaagcatgagccaccgcacccrgcccacagacacttttgaagcctctggcccttgctgtctgctaattctcaygtcgtcagaattgccactatcatttaatgggctgctttttcaattcaaactcgtgaaaatattacgaataattatctctgcactttgtcctgcctttcctttccatttccctggccaagactaatgtcacttttgaataaaatgaacaaatataattctttgtataaaactaggggaaacccagggatacagaacaggaaggctggtttatatgccaataactcatctgtaaattcatgtaaatgtaattctgtgcattatagctaatgcacctaaagtcaattcttaatgtctaaggatgagcaaatgtgtaactcttcattgtgtagaggggtatagagcttagcttgccatgtcctgggtacatttccagtagtcatttagttagtaccagtgattcccactcaagtgtcccgtaaggaggtaccatgggaaataagagcagcctcttggcattctgggtagggagcctgagccaaactctaaagctgtctttataaagggaggtcatgtgatggccagaaattgcctttgcttcatgrtgcacttggtggggagtcaggtgtggggtgctgggtttcacatcatcccattttcttttctgccttcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagcttttgctggttgattcactggcatatgaaattcagcagccagggaaggaggttgagtctggagataaacaaggagcagacactttgtagcacaagtagtcagaagagagcccaaactcaggtagattgtggccttgagagaggaaagtggaaggtgctctgagcagggcagcatgcttgaggacaaggtgggcctaagtagtgtctaactctgtggcagtggtgttgtgttgggtgaagtcaagcctgtccccaaggttctgccgggtctagttggctgttggaagtgctagatgtttgtgttttgcaagcacagcatcagtggaggcttgcactgtgtctgtgctaaaggaggttggagcagctatctgtgaacgtgaggatgcttctgcatggtgtgctttgctttggccagtggggagcactgggatgtccttatctcctggggcattcttgcttgtcccaatgcttccgaaagcctgcttagtgggtgcagcactgaaccaggagtcaagagacccagggtttagtcccagcctctcactaggtggcctcgagttctcccattccctctctaagcttgagtttcttcatctctcaaatggggttaagaatagccccctttcccacctcacagggctgttatgaggatcccaggagacaaggtaggtgaaaggagccgcacacttgggagactctatccttgcactttgtaacaatgttgggaaagacatgcttgttgacactctgggttggaccaggcacaacactcctgcaggccttggcggaatcgttgggtgcctgtgctgtgttcatgtgccgaggtccacggtggaaggagattgctgagtagctgggtgttcttggtgtcctggaactgggtccctccttgcagcttcatacctggggtttgtaccaccaggacacctgctgtgaaagcagggaagtagtagtgaaggtctcttaagctgtctgttctgttttctgacatgtcattagagcccattgctgacaggagcttcctccaggttgcaagcggtgggcttgcgcatgcagggagagttatcaggctgtggctgactgtcttgactggggctnccccagccctagaaataatntcgtttcttgtcttgcttcatcctaacctggcttcctgacagctcccccggataactcaaaacctgctgtaacaagctgttagcaggcattttgtcaagttttcaatatggaagttcccagtcnragaactggggtcagagaccagaggttgaaaactgctgagtggagaagggtgctcatgataaaactcagaaagcccagaccagatggtggagtagggcagaaactggacaggagacccagggctacagcccttgaagcccagctcaggaggagagaaaaactgagagcagcagggacagtgggaaagttggcccagtaaggaagcagctgatgtggcaaagccaacaactattgtacatcaggatttattttccaagggctagtaaagagaacttgggcaacagccataagctacatgaccggaatggagaatccagaagagtaaaccagagtctactttttctcagaaaagccaagactgggtctggatcacaggccaaacatctctgggttccagagccagagcgggaagtccctttcctgcaagaagactaaagaaggtgctggtccaacccatgctgggtactcagaaagaagagaaaacaatkgcagtttttatcagaagagaaggagcaggattctactcctggactcattccttgggcagaaataggaagagmcaaaaaaaaaaaaaaaaaaaaaggaagaggataaagttctttctgagcaccaaaaacattgagacattggaatcaaaatgcagagagctctgtgtcctcctttgccctgctgccaccaagcctgtacctacaggaggggttgcacgaataaacgaatgttcttatctctgcatgtgttcaaacaaaggctgaatgtcagaacagttaagattgaatcaggtgaacttccaggtgccctcagatccttcaatcccaacaattcttaaatagttgacttaagtatctacctatagatctgtctttttcartttttgccacaaaaatgactcctggctgtgaagaatggcaaagaggaaaggcagcctgactcctgcagcctcacacgtgagtcagatgcaagttgaagagacagatgactctggctttgtcatacagacatatcaggatgtgtatgatactatttgtacaggaagatcatttgcagtggagggagtattatggctagaaaagcttgttcccacatttttgagttgaggaaatcagttgagttgaacagtggaaaagggagaaggccctggctgatcaccatgattttcttcctttaaagtttctgtagcaggatctttgtatatatgcctatgtgctggtatggtgaagaggaacagattatcaggaatccgcctttgacagagacatttgaatgcaaacatcattgcttgaaaggtagaggaagccttctccccagtcagaggtaagcacacaagtggatggatgcagggaacctgctgttcccctggactcacatcaagctatgtaggcccactccaacacagtgcagttgggaatggccccttcagggtttggacaaggagaaagcagtccccaacccctgcattgatgtggaacctgccaaaggatgatttgcttctggagtgccaagtgcaggcacaccaggcaagaaaatgcaactgaggagcagtggccttttgctaataagaccatcgtctctggagtgaaagggccggtggcttgttggttgtagtggcagtcatatgtgtgctcagcatctccattgcgtggatggctggatcaagctgcctctttggatcttggttaatcagtggtgaatgggtgggtaagtttagaattccggctaaatatgtctggcttcaaagacgtattctgctcagaagctcagcttctgtttcatcctaacacttggctgctgagttgctctgtgtttaaattctaggctttaagtggcagctgtggatccactcctaccaccccgccatgtggttttgctatagatagtacagtctgcagctggggtaaagtcaagaggactcagccacgtgtttctaagactgtttttcaggaaaactcagcaagacagtttcgctgttgttgcccagactggagtgcaatggcgcgatctcagctcatcacaacctccacctccttggttcaagcgattctccttcctcagcctccctagttagctgggattacaggcatgcaccaccacgcccggctaattttgtatttttagtagagacagggtttctccatgttggtcaggctggtccggaactcccaacctcaggtgatctgcctgcctcggcctcccaaagtgcatgagccactgcgcccagccaaactcagcaagtttttattgagcatctgctgtgttctcttggtatagctctcccagtaaggagtaaacataataattcctggtgctctcccgctcctttctgtccccttttgattgcagtggacctgctctggttcatcacagggagagagcttcatgctattttagagaccccacaagggattaaaaaactaaggaaaggccgggcacggtggctcacgcctgtaatcccagcactttgggaggccgaggcgggtggatcgcgaagtcaggagatccgagaccatcctggctaacatggtgaaaccccgtctctactaaaaatacaaaaaaaattagccaggtatggtggcgggcgcctgtagtcccagctaccagggaggctgaggcaggagaatggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgttttaggggactctacagtaccaccccaaggggcagggctaacagcctctttcccattagccttgtctcctcactcctgactacagcctccctcttagggatgtctacatgggaccctcttacaccaatctatacccatgatcagcctcaggcagaccactgcggtcatagcacaggacaacttgctctaccaggcagggcaggacaccagcacctggtctagacagatctttgaagtagctgtattgggaaaggaaggaaaattggcccaatcccacatttcccttcagaaccactaactgctgctgtcagaggagaacttgttaaataaagttcccacaggccagccctgtttttccagcagcttccattctaacataccattatggtcgaaaaatacatgagtgtaaatggtaataatgaaacctattgtaaaagtccactggatatttctagggctcagggctaagacacaggaaccaattaacccatttatgctggaggttacaaacttttttgtgaaaaatcagactttaatgatgatcttgagcagtaggatacaaataattcctaaaaggttagcgtcccaataatggaacatgaggcataagtgggttaaagcatctgcccagtagctaagggccaagttctggtggcacatgatcctggggttggagtccaggctctgccactcagtagctgtacgtgtgaccaggttacttaacctcaccaagcctcttttttttttgagacggagtctcrctctgttgcccaggctggagcgcagtggcatgatctcagcttacaggtgcctgctaccacgcccagctaattttttatatttttagtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcagcacttcctaaaggtgaacctttattacagttccagcagcattcaaaataccatgccaattcagacttttttaaaacaaatctcatgcagacattacacagtactcttcagcctctgaccctttaccctttagcagtggatctcactgttatcctgtgactgtgtaattttgaaagtgaatggaaacacctgatgatgagtcaaccagatctgaagtggattaaagggacactgtcagggtgctggcaccctaagtgggccttatactaaaaagcttcagttcctgctaaaagcaccttctgatccttgactacagtggggtttgatggcatacctccttcctgtgaaacccaagtcaaaatccttttatcggcctgcctgattctgtatccttggacgcatggctgctgtggaagttggcccaagatrtgttcttcccagcctgagatatctcgtggatcagactgaccgaagcatctgggaggtgggctggaacagtcccaagaaggccggattgtcctcccccaaaataaagacagagatcatccstgtttcttctcctgtacgcgaacctggtggatgctccaaaatcgaaccaaaacactaccatgaataagagatgactgcactcctctgacacaacttcctatttttgtctttgttcttcaaaaggtctaaacagttactaaatcctgttatgctgaaggtggggaagttagaaaaatagaacatctcctgacaggtagaagacgggatccttggaggcgttcctttgggatttcattttacctccatctcgtttgttgtccagtttccttttacgaggattaagcaggcatcctgctggctagaatcctgtggcttccctggagcctcaaattcttgtctaaccacatttctagtcatggttcctgcaggagacatccactcaaaccacctgttactgaggcaccaagcaaccctagaggcagttggcctctggccctagcaggagcaggatctcaggccatcccaccaggcagccagcctcagcccctcaccgcagccttgcagagtgggctctgcagagaagccgatttgtggacagtgccaccctccatcctgagtcacatggctcatgtggttgcagccatttttgagccaggagggggccccttctaggtgcagctgacctgggaatgctagccagagcggccagaggagaggagtgggggaaggagagaggtatctcttgctggccgcgggatctcatctccttttgtcttgtttaggtttctcctctgcctcctacttaaaggtccatgttaaaacccaccacggtgttccccttccccaggtctccaggcaccaggagcccatcctgaatgggggagcagcgttccactgcgccaggacctatggcaacaaaggcaagcgaccccttgctctgcactttgcttctctgcgcagactgtgttgtgggggcgctgggctgggcgtggggaggcgggaaggctgccggctttctggctgccttgaggagactcagagatctgagtggcagtggcctccaggacaaaagtcacagtgggtatctcactccagggcagtgagtgaggctttagggcactgccgagatccagcctccgcctcctcttccccagccctcctcctttcctcctggccagcccccactgtctggagccctgcagggatgccccgggccctgggcagaagaagagccctgcatgatgagtcactatgggcctgtcactgcctgctgccctttaggatggtgtggagctgcggctgaatgctttctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctgagccattgatggggtctacccaggttgaggacctaatggctctggttctgcctgtcttgctagggtgcagctagtctggtgcaggaggcgaggctactattacactggctcggcatcatcagaataccaattttaccctcagaggcacccaaaagagcgcctaggagttgggggtctttgagttgttctgggcagctgtagcagagttgccctctctgtatcccttccttgaagcaggctgagatgacggtgagcagtacatgtgcagctgcatgaagagtccacagcaagggaggctggcagccctagggccctgccgtttcacccctgtaggcactccaggctcccagactgaccagctgaccctccgtgggttctgccagggcagtggctggccaatggctgccctccacaggtctgtgagctggcccctcatgacccctccaggagggggcatctccagagcctggcctcatcgctctcctatattttgttttttcgtagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcggrggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgamgggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgctcccttgagtccagtttttcagctgtgggggtctttgggacccagaggtgggcagtccataccccagcacctggggtgggagtgggatcccaggagaccccttttccacttcattgcaccagttccactgggattgacaggtagatggtcccactgaagacttagaatgccagaattcacccatgtgttcaacaaatatccactgcttgtcttcactgcttgtgtgccaggcatggtttcatgctcttgagatatggtggtgaacaagacaccactgtgaggcttaatgggatagacagacaacttaaatatgagttcagataatgagaaatacaaggagaagaactgggcaaggtgaggggacagtgacagcaggagggtgagtagggtggaccagggaggtgtgaagtggggttggggctctgggagggaaggcttatagaggggatctgacacagcctacccagctagcacctgaggagggatgtgggcagggactcctcatggccaaggggctctaagaagctcagcaacttgtctcccccaccatgttatctacctgatgttaagtaaaaggttggtgcaccgttaatggtgaatgtatgaagaaaagagggaaagaacaacaaacaggaggcaagaagtaagcacgatggagaattaataggaataagaatgaggaacaagaagggacaggcagacttaaggcaccctgggcatcttgagaaatctcagggaagagggaaacccctaaaaggatagagacagcatttaacctccaagcaagaagaaaacaaaacaatggtaaaggagagaaaaacagacctaggggaacaaacagcacaaaaatttttagacccacattggtatcagaattacattattttttgtttttttgagacggagttttgctcttgttgcccaggctggagtgcagtggtgtgatctcggctcactgcaacctccgcctcccaggtccaagcaattctcctgcctcagcctcctgagtaactggagtaactgggattaaaggcatgcaccacaatgcctggctaatttttgtatttttagtagagacggggtttcaccacattggccaggctggtctcgaactcctgacctcaggtgatctgcctgcctgggcctcccaaagtgctgggattacaggcgtgagccactgcaccctgcctagaattacattgttctggtgtaaaggtaaagactctcagctgaattttttaaaaaacaattctaagccatttacacaaaatccttggtaagctgctgggctttgcagactgtgtggaatagaggcttaggccattagatgtgagtatcaaaggaaagggtgaccctagaatgtggaggccctgtggacacgtagctttgtgaccaccacagaatctggtcacacccactgagtgttaagagaacctggccttgaaccaaggacttgactgggccagcccgagctcctgaacgcattttagttctgctccctggagacctgtgagcatgtccatggacaggtagggaccacaggtattagaaaggagtatctgtcacatggcaggaggggaacaacagagcaagcaggctgttgcatcttccaaagcactgctcccttggcagcctaagctttgggaggctaaggcaggaggatcacttgaggccaggggtttgagaccagcctgggccacataggaagactccatctctacaaaaaatgaagaacagctgcacatggtggtgcccgcttgtagtcctagctactcaggaggctaaggcaagaggatcgcttgagcccaggtgttcaaggtcacagtgagctatgatcacgccactgcattcaagcctgggtaacagagtgaggccctaacgctaaaaaaaaaaaaaaaaaaaaaaaggaagaaccacctgagctttggctattcggctccatcatctgctctctgccaaccttggggaaatccctaaatctctgagcctgtttcctgatcaggtcttttgtggagaccaaaagaaaccatcatcatgagctaatcccctgcacaacctataaggttggtttcattattctattatcatccccctcttgcaggaaacaggctcagagggatggaggaactcccctgggtcacatagtaagtggaagagtcaggattcaaactgaggtctgccttgtcctcagactttactcctaagctcccagtgatagtttctggttttttgttttttggtgttttttttttagacagagtctcactctgtcacctaggctgcagtggtgctatctcggctcacctccacctcccgggttcaagcgattctcctgcctcagcctctcaagtagctgggattacaggcacacgccaccacacctggctaattatttttttgtattttttgtagagacaaggtttcaccatattggtaaggctggtctcaaactcctggcctcaagtgatccgcccgccttggcctcccaaagtgctgggattacaggcgtgagccatggtgcccagctcacaagtgcctcttgaaggaggaaattccacagccatgccctctcttaccttgagtgacaatgatcagcactcactctaaaggtacctaaaacttacccagaagtatcactagcgtctcacaaatccctcctgtccattggaggaggaaggctggcgggattccctccagtttacataattgtgcctggctgcttagcacctggcagcagtgtctccagaattctactccttacaaactctacctctcagtctctctcccaaggctgcgtaccctactctgcacctctccaagagtggaggacgactggtagatggtgtgaaatgattttcactgggggaaggtaggagaagggcagaatgattaatgtctggatttgcatctcttgctaaactgctgtgaaaggaaataccaaatatttatctaagagactaatccatcctaacaaaacaagtttcctttaaggacagggcagtgcagaggtaggagcctctgaaataaaacttctttgtatcactgtgaatgggcataccaaaaaaataacttatttttccttcagggaagtcttctgccctccaaaatctggcaccctaccccatggccagtccataccaggcagaggtcagagcctgtggcagcaatgaagagggacttcgagattattaacatctccctccctccttccaagtcaaaatctgtgccctgaagctgctgaatgttttggagtccatgttaagcagcacaaactccatgagctgtggggcttgtgtttcatttttcaaagcttttctttggatgatgataaactattgtttatttgtgaagtttcctctgcctctaaaatacttatctcttgtctatctaaggaactctttttcagaagctcagttcagattgccccttgcctacaaagcttttcctgccccctccgcaagacagcttatgtgtattacatcactaccatgtgctaagcaccatgacaggggtcttacatacatcaacaaccctatgctgtaggtattattttgttctcatggagtcccagagaagcaactgccaatgtcacatagctgtgaagtggcagagccaggacttgaattcagaactgtctgaccagggagcccaggactccatcatgatggatgtgatactttgtgccacctccctgttttgcacatatttccacttttgcatcatctttttagggatctatctccccacatgagaccagatttctttgccaatggggatcaggcaaagataattcatctctgtattcccattgcctagaataatagttcctggcacttggcagccactaattcattcaacagatattctgagtgtgctaagagagacttaattcctgtcctcaaggagctttagcataaagtagcacaggacatgggacatacacataaataagtgtctataacacaagagagaatgaggcatgggaagtgatggaaaatacatgctctggtgctgtggagaaagatgggatgccgtcctggtctaagatgctggccaggtggcattagagtaggaccctggagcacactaggactgggacatgtagggaggggggcagggtgctcacaggcggacatgggcaaacttgcccttcaagtccaagtaacagctgacatttgaagtgacaaacctcttcatgtcaccaagggagacaaagggccctttcagactgtagaagctgctggaaaatgctggccagccatcggactgtgaagagccccgggggcaggatagaccatgttctaacatggaggccagtttggtgggaagcatactgaggctggacaccaggatgaacacaggataaaatgatgttaccttccctcactcgaggctgcctttcccaataacacagccccatacctcacaaccctcttgcatgcccagggccagagctcaggaggaaaggccaagccagagcattgggtgggaatgcaggagaggtggacatcctcattacatggggcctcttcccagggctcaccccactacaggtcctgagaatattttaaaatgctttcaactgtgtaaacaaacgaggcacctgagaaccccaagtaggccatgcctatggaagccatattccctgcccgtttcacatttcctcagactgttgtttaatgtcagcctgagcatctgccctccacacctcctgctgtatgggatcatccttctcattaatactgaagttagaatggctttggccccattccataaagggtgggaggcatctcctccaacatctccaaacatggtgaaaccctgtctctactaaaaatacaaaattagccaggtgtggtagcacacacctgtaatcccagctacttgggaggctgaggcagggaaatcacttgaacctgggaggcagaggttacagtgagccgggattgtgccattgcactccatcctgggcgaaagagtgagactccgtctcaaaaaaaaaaaaggtcccttctcaagcaaggtgcagtagcacatgactgtagtcccagctactcaggaggctaaggcaggaggatggcttaagcccagtccagcctgggcaacataccaagtccctgtttctaaaaaaaaaaaaaaatgtttaaatggtccctctctccactggcatcagcccagacatggaacctagggcttttccttcattttttttcaaaatcagtaggtgctctgatgttcaccctgatttggggacaacagagactaagtcatagccagcacataaaacgcactgacagtccagtcccttcatacctgccacaggaaacatctccctggtgaggctgttcctcagtaccctcagctgccctcaggtggctgctcattctcaatctccccagccacctgtcctacttccttggccccctcaattccttcatcctgggcttatccccatcccctccccagagacacacaattctcactgtattttgcaggttacttagattttttctttttccttttttttttttgagacagggtctctgttacccaggctggagttgcgtggtgtgatctcgtcactgcagcctcaacgtcctgggctcaagtgatcctcctaccccagccccccaaatagctgggacgaccacaggtgtgcaccgtcacacctggctaatttctaatttctttcatttttggtagagacaggctttcgccatgttgcctaggctggtcttgaactcctgagctcaagtgatctgctcaccttggcctcctaaagtgctgggattacaggtgtgggccactgtgcccagtcgagatctttctttttctaattatgaactatgttgagtggggataaggaggaacagggattcacctttcatgtccaaacagattatcaaggtacttcctgaaaaaagacaatttcctaagaggaatactgcagccagctttttagatagcaatctttatcttctcattataatatta

SEQ ID NO: 10761 - DNA, 15213 bp, Homo sapiens
acaaaattagccaggtgtggtggtgcatgcctgttatcccaactacttgggaggctaaggcaggagaatcacttgaacccaggaagcggggaggttgcagtgagccaagattgcctcgctgctctctagcctgggtgacagagcaagactgtctcaaaaaaaaaaaaaaagaaagaaaaacccagatataataattgaaataaaaactcaagatatgggctccacagcagaatggagggaacaaagaatcaatgaaccagaagatggaacaatagaaattacccattctgaacaggacagagaaaatagagcataaaaaatgaacagaggctcaggaacctgtgggggcataccaaaagaactaacctttgtgtcactggagtcccagaaggaggccagaaggagggtggagctaaaaaaagtactcaaagaaataatggctggaaactaagcaaattggcaaaaggcataaaccagagattcaagaagctgaacaaatcccaaacaggataaacccaaaggaatccacaccgaggcatcatagtgaaatttctgcaaactaaggacaaaacatctttaaagcagtgaaggagaaatgacaccttacctacagggcagtaacaatttgaatgagagtagattcctcatcagaaaccatggaggacagaaggaagttgcacaatatttttcaagtgctgaaagaaaacaactgtcatccccaaatcctatatccagtgraactatccttcagggaaagaatttgttgccagtatacctaccttaaaatatttgctaatgcaagttctccaaacagaaaggaaacaatttaaaaagcaatcttggaatatcaagaaggaagaaacaacacaagaaacaaaaatatgagtaaatacaatagacttttctttttctcttgaggttcctaaattatgtttggtggttgaatccaaaattataacactttctaaatgtggtcctaagtgtatgtacaggaaatattttaaacatattataaatgaaggagggtaaaaggacacacagggaggtacattttctatgcttcatttgaactggtaaaaatatcagttagtgatatcaatcagtaaactgataagttgcgtatatatagtataatacctagagtaatcagtaaaaagctataaaaagtgatacactcaaaaaaacaacccactacagctaaatcaaaacagaattctaaaaaaatgttccaataacccacaggaagttagaaaaatgaaaacagagagacaaacaaaaaaacagagaaaacaaacaggaaacaaaaaatggcagagttaatctctactmatcaataattatgttaatgtaaatggtttgagcacatcaattaaaacaaacattgggagaatgggtttaaaaaatcatgacccaactatatgtctcaaaattaatttcaaatataatgatatatgcagtttgaaagtaaaaagacaaaaatgcatacaattattaatgtaaaaataaagcaggagctgggtgcagtggctcatgcctgtaatcccagcactttgggaggctgaggcaggaggatcacctaaggtcaggagtttgagaccagcctggccaacatggtgaaaccccatctctactaaaaatacaaaattagctgctgtggtgatgggcgcctgtaatcccagctactccggaggctgaggcgggagaattgcttgaacctgggaggtggaggttgctgtgagccgagatcataccattgcactccagcctgggagacaagagcaaaactctgtctcaaaaataaataaataaataaaaataagaataaataaataactgaatagataaattaattaataaagcaggagtagccataatatcatataaagtagacatgagagcaaagaaaagcatcagagacagcatgggacatatcagagacatagtgggatattatatagtgataaaagaagaaaacatagcaatcccaaatgtatatatacaaaactgcaaaatgtatgaagcaaaaactgacagaaggagaaatagagaaatccacaattaattacaattggagacttcaatgaccttcaacaactgatagaccaacaagacagaaaatcagcagagatatagaagaactcaataacaccatcaactaacagcatctgattaatatttataaaacactccaataccagaatacaccagaacactccaataccagaatacaccagaataaaaaatactagaatacaccagaataaaaaatactagaatacaccagaataaacaataccagaatacacattattttcaaatgctcacagaacctgtataagataaccacaacctcagccgtaaaactgacctcaaccaaattaatagtgaaatcgtacagagtgggttctctacgcacaatgaaattaaactaaaaatgaataatggaaagataagaggaaaaccttcaagtgcacggatatgtagcaacatacttctaaataatctatgaatcaaaaagaatatctcaagggaaatttaaaaatacattgacctgaattgaaagtgaaaatacaacacatcaaattttgtgagacatagctaacacagtgcagagaggaaaattttatagcactaaatatgtacattagaaaagaggaaaattctcaaactggtcacccaccagtttatcagtttcaagcttctacctcgagaatctagaaaaagatgaggaaaataaacccaaagcattcagaaataaggaaataacaaagataatagaagaaatcaagaaaattcaaagcaaatagagaaagcaataaagaaacaaagaactggttctttgaaaaacattttaaaaaatgacaaacctctagcaatactgacaaaaagtcttacccaatcatttcagatttcaaatgtgatttagtatcaaatcctttatattttcaacttccttgcaacatatctcctgttaattgagtttctttaagtgattgcttatatatcatctctaacttttccctgtattactatgtttttctttctatataactaaagaagagttttaagagattcaatttgtccttgaaggtcttttcctttctcttttgataaacttgaataattttttaaaattataatgggattaactgaaacataaaatggaaatcagcttgatcagctatgtagtacaggtacaggttgggcatccctaatccaaaaatccaaaaataggaactgctccaaaacccaaaactttttgagccaacctgatgccacaagtagaaaattccacacataagtacgtaatgcaaactttgtttcatgcacaaaattgtttaaaaatattaagcaaaattaccttcagcctatttgtataagatgtatatgaaacttaaatgaatttcatgtttagacttggttttcattaccaagatatcccggtatgtacatgcaaatattctaatatctaaaaaatctgaaatctgaaacacttctggtctcaagcattttggacaagggctgttcaacctgtcattacaggctaactaaataaaattaattttaacatactttacaatgttcagtcagttgaaatactatttcagcttgctggtaacagtccagctaaattaatctatcacttcactttagcatacatgagcataaagaatatggggcatggtgctttttcacattgtctacttttccatcatgtgtccagatgagaccaaggttttgctccccagttaacaaaactgagcttcaaaatatgattaagatgatttccagtgaatgatgaaaatgttccgtatcttgaaaaaagtgtgagttacacacatgaatccatttgttaaaatggtacagttaagattggtgcatttcaatttctgtaaacattgccttaagaaaagaactatacaaaagtaatcattaagcgggaagcagagaatggagagaaaggtatagacaaaacaagacaacagaatgttgtgaaactgattgtgtacagaggcttattctgtttactttgtatatgttagaatttttccataataaaaattttaagttaatgagtccttgtgagaacatgtttacgaatgcaaacttaattcaactctactctagtcaatcaaatcaaagcaaaagagggcaacacagagaaacattctcctgaaacaatctaacgtaatccattttctataaaaaggcagtttcttgatagacccaactgatatctttttggggtactttgagctattatcctctttctatataactaccaatgttatcaaagacatttcaaggatctaaatggagtttgacaaatactgtactgctgataaatttgctctgacgtaaaaaaataattcaacaacctatattcgaggatgcctggtggtgcttcagagaaacagagtgaataaaagactttgtggatgccgttaagctggaatcagaactcagaatgctcaccgaaagaaggaagcatttaagattgagcaggaaataatggccttgtttcagcaaagagatgacaccagtccaatatgtttattattgttggtttatttcataatttcattttgttacattctcaaggaacagtgtgttcccagtagcatctatcaagtgaaccctggaggctggtcacattcataatcttttgtttttctggctacatagaggtgattttgaactacaagatcatctcagctattcagagtttagattttatttagccttatttgttttgcctagcatttatgtatttgaaaatatcttgatttttaatcttctatcaccttggcccttacctgaagtgaactttgtttgaactcaattgatttcacctctcaataaatatgaaattaatctgaaatgaattgaattgtttggcatattttacctcttctatgtgcactaatctatttcacacattttcagtttgtttagagatacatgttccaatgtatctgagtagaaactagtgagatgggaatggatatagccataatattccatcattgaattccatggcattcactcaaatgtaactcacctgttttaacagtaccttaatttggcctgtatttattggacttggtgttctttttgctgtgagaagacggtgaaggtgattcttgaatgtttgttttctgygttgcatcatgtttgtacaacacggtaatatatttggaccttgattaaataatgtaagaggggaatttgatcaaaaaataaaatgcacaagactgttaaaacaatgtctaattctatccatgcaaaaatggagtagaatcctaaaatgcttatgacaactacttgattgcttctagtccctcttttaaatactttaatttacttagatacatgtatcatacgtacttcttggcctcagttttcctcctaatagcctaattgttctttttactgtgcaggcataactatataacaaagtaggttttttttttcatgccatttatgagtcatataatttagataatttattgtttattttaccattattgttgctaacaaacttcgttgttttgcattgtttgttgggacaattaaatagtgtacctcttggactaatagattaaatagttcatcagagataaattgcactgctgaagcatcaaaggagaaagactgaagtgtagaatctgcacttcaatctttctccttaattagcaccaccagggaatttgattcaagttctagaggggagtgaacccaggaattggcttaaaaacaaaaacatacacacaaaaaaaccaacgctcgcaagcaattatttatgcatgcggtccacgcactcagtttgagaaacactgactcgacttaaaagtctttataatgctcagatttctgaaatgctattgacctgaaaacatctcatgaagttattagtttgaacgcgtggtggcggtacaagctaagagagtgaatgaaagctctgcagactcggtggactccgtttcatccagaagccaagtaaaaatacagaccacgtttacagctaaagctgagatagatgtgtccgggaaggyagtcgtcgccagacaagttgtaagaacgaatttaaaaatctctgcaaagacatccgagagggtcgasggtagatgtggtgattgggagctgaaaaggatttttcttccgtattcrgacataatagacatgatgcaaactaaagtacagaacaagaaaaggcaagtggctttcttcattttattgatgctttggggagaggtgggttctgaatcgattcagtattccgtattggaggagacagaaagtggcacgtttgtggccaacttgacaaaggacctgggactgagggtgggggagctggcttcgcggggcgctcgggttgttttcaaagggaacagacaacatttgcagtttgatccacagacccatgatttactgctaaatgaaaaactggaccgggaggagctgtgtggctccactgagccgtgtgtgctacctttccaagtgttactggaaaaccccttgcagttttttcaggcttccttgcgagtcagagatataaatgaccacgccccggaattccctgccagagaaatgctcctgaaaatatcagaaattactatgccaggaaagatatttcctttgaaaatggcacacgatttagacaccggcagcaacggccttcagaggtacacaatcagctccaaccctcacttccacgttctcacccgcaatcgcagcgaaggcaggaarttcccggagctggtgctagacaaaccgttggaccgcgaggagcagccccaactcaggctaacgctgatcgcgctggatggcgggtctccgccccggtcagggacctccgagattcagatccagrttttsgacatcaatgacaacgtccccgagtttgctcaggagctctatgaagcacaagtccctgagaacaaccccctcggctctctggttattaccgtctcagccagagatttagatgcaggatcgtttgggaaggtatcttacgccctgtttcaagtcgatgacgtcaaccaacccttcgaaataaackcaatcacaggagaaattcggctgagaaaggctttggattttgaggaaattcagtcttatsacgtggatgttgaggctacagatggtggaggcctatcaggaaaatgctctttagtcgtcagggtcctggacgtsaatgycaatgcccctgaactcaccatgtcgttcttcatcagcctcatcccagaaaacttaccagagatcacagtggcagttttcagtgtttcagatgcagactctggacataaccaacaggttatttgttcaatagagaacaatctcccctttctyctaagaccttccgtggagaatttctacaccctggtaacagaaggcgcgctggacmgagagagcagagccgagtacaacatcactatcacggtcactgatttggggacaccaaggctgaaaacccagcagagcataactgtgcaggtctccgacgtcaatgacaacgcccccgccttcacccaaacctcctacaccctgttcgtccgsgagaacaacagccccgccctgcacatcggcagcgtcagcgccacagacagagactcaggcatcaacgcccaggtcacctactcgctgctgccgccccaggacccgcacctgcccctctcttccctggtctccatcaacgcggacaacggccacctgttygccctcaggtcgctggactacgaggccctgcagtctttcgagttccgcgtgggcgccacagaccgcggctccccggcgttgagcagcgaggcgctggtgcgcttgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccggtctgttcggcgtgtgggcgcacaatggcgaggtgcgcaccgccaggctgctgagcgagcgagacgcagccaagcagaggctggtggtgcttgtcaaggacaatggcgagcctccgcgctcggccaccgccacgctgcacgtgctcctggtggacggcttctcccagccctacctgcctctccctgaggcggcmccggcccaagcccaggccgactctytcaccgtctacctggtggtggcgttggcctcggtgtcgtcgctcttcctcttttcggtgctcctgttcgtggcggtgcggctgtgcaggaggagcagggcggcctcggtgggtcgctactcggtgcccgagggtccctttccagggcatctggtggatgtgagcggcaccgggaccctatcccagagctaccagtacaaggtgtgtctgacgggaggctcagaaacaaatgagttcaagttcctgaagccgattatgcccaacttccctcctcagggcactgagagagaaatggaagaaacccccacctctcggaatagcttcccgttcagttaagtgtgggattattttactaaatcttacttatgtttggagatctcttttaacttaaagttacatggtctgtttcttgtttattttacctctattctttaggttgaaattttatataaagtaagatactggtatcttagtatttcctgttcatgcttagtagtttattacttcacttgagggtacttgacaatatgaacaaaaagtaaatttttatttgcataattttaagcttttgaaattaaattatctattcttccccccccccaaaaaaaagtattgtaaatccttaagtaaaattgtatttctagctattggtaagagttgtttcactattgctatgtaggactgtttaaaatgtgagtatctgatattatttaatcctccaatgtctcattttgcagtaactcctacagtgtgtaacactaaaaataagaactaatgatggctaaacactaaagtagccattcatacttatgcatattttagtatcccataatagtcaatccaaaatttttgtgactatagactttactgaagtgtcaacacattagtttgtgagcctcatgtaagaacatgatggtctttttttaaaaaaaaagtcgtgccaattataagtgcttaataaatatttgctgaatgttactaacattctagtattgattttttaaaaaaactattgtatctacagcgaaatgctaatatcctctctacaataaaatatccttaccaatgagtgaaagtatgaaatatcacttcttagtcaaatcactgttgctttccttcaaaacagaaaacagctttgactcttctactcaccctacacaccgttacagaaaataaaatgcttaacagcatattttatctttttttctttgtctcacaatttgaaagttgaaagatttcaaattatatttgccaaactcctcctctcactttctcaagatgtttgatatctaccaagatctaagtaaggtattagtggcaggttattcggtaacatcagattttcccttctagtgttgtgtaagcatcatttgcttgtattaaccattacaccatttaccttcacagtttagcccatatctagtcttatttgtgtcagctgtatttgtgatatttcatttaaaaatccctctttcaactttctatcaaaggcaagcaatgtatattaaaataacaattcagtgactattttattttattttgagacggagttttgctcttgttgcccaggttggactgtaatggtgcgatcttcgctcactgcaacctccgcctccctggttcaagtgattctcctgcctcagcctccttagtaactaagattacaggcgcatgccaccaaacccagctaatttttgtatttttaggagagacagggtttcaccatcttgaccaggctggtctcgaattcctgacctcatgatccacccgcctcagcctcccaaagcgctgggattacaggtgtgagccaccacaccyggctgactattttatttttatccttaattgaagtggaactgggctgaactaaattacatttgactgtgttttgtgtccagataagtgaactgactgtcatggatgattaccaactgattaaatgagtgtggggaacatttactattttgtgttctcagatatataccctattctccttagaacagcattcttccttggtgagattccttcttccattgttctcactccagtcacttggctttagttggagcagtagtgtttttcaatatccccatccccctaatcctagagaatgtacactggggtagtatactgtccaatgcagacaggtcaatacccttccccagacagtgtatttttgactttgtcaactttgttgtcttctttacatctgtagaaaagacattgcctagattctgagcttatattgattttttttttttttttttgagacagagtcttgctctgtcacccgggctgaaatgcagtggcacaatctcagctcactgcaacatccacctcccaggttcaagtgattcttctgcctcagcctcctgagtagctgggactacaggtgtgcaccaccacacccgattaatttttatatttttagtagaaacgaggtttcaccatattggccaggctggtctcaaactcttggcctccagtgatccacccacctcagcctcccaaagtgctgggattacaggcgtgagccaccacacctggcctatattgatttttaataagacaaaccaccattttctctaaatttcactgggcattgcacataataaatttatgaagcaaaaaaagtcctaaatggtggccaggtatggtagctcaagcctgtaatcccagcactttgggaggccgaggcaggcagatcacttgaggccaggagttcaagaccatcctggccaatatggtgaaatgtcatgtctactaaaactacaaaaattagcctggtgtggtagcacgcacctgtagtcctagcttctcaggaggctgagtcaggagaatcgcttgaacctgggaggtagaggttgcagtgggccaagattgaggccactgcactccagcctgggcaacagagtgagaccacgtctcaaaaaaaaaaacaaaaaattcccaatggttatgtagaccagagactaacaagaaacaatatttttattttctttcgggagttacaggcacattacaatatgagaatgaaactagattttgaaagttcatgatttcttccagtacaatagaacaaattagcatttttgtaatagaatgtaaattccccaagagcaagaatttttatgtttcatttactgtattatcccaggaagctacatgaatgtccctacaggtaaatacttgttaataaatgaatttgcctggagcagagttttgtgtactgaacctgcacctttataaggaagatgaatatagatacagacattacttttgctgtaacaaccattcttagctacctgaacaaggcctcataatagccgggggaaaagggagtatataacaggctatgacctaaaaggcctgctatatgttttagctattacagtatacagtgtgctttgaaatgaaaattatctgaagttgtaaagcagaacgcttggtggcgctgcaggctgagtgaaaaactgcagaatcagtgtctccttaaaagctgtgcgggttttctggcagctccaaaaggaaacactttttcactactggggataggtttcagagaggcagccatcccatgtcggtcaatgttaaaaagaactaactcaagatatttaaatcaagatagctgagttggctgtaaagcaattattttgtgattaaatactgcatcttttggaccctgaggaatgatggagacgccgctccccaaagcaccagagaaaaggcaagtgaccgccattattttcttattactactgtgggaggcgggcagcgctacgattaagtattcagttctagaagagagggacagcggctcttttgtggccaacttagcaaaagatctggggctgggtgtaggggaactggccgcgagaggcgcccggattctttccaaagggaacaaacagtatttgcagctcgaacggaagagtgggaatttgctcctaaaagaaaaattggaccgggaagagttgtgcggtgacatagatccatgtatactacatttccagatgttactgaaaaatccggtgcagtttattcaaggtgaactacagctccaagatgtaaatgaccatgccccagaattcttggaaaatgaaatcctcctgaaaatctccgaaggcagccatccagggacttcatttcctttgaaaatagctcaagatttggacgtaggtagcaacacagttcagaactactcaattagcaccaactcctatttccaccttttcactcgcaatcacagcgacggcaagaaatacccagagctcgtgctggatcaagcgctggacckcgaggagcagccccagctcaggttaaccctcacagcgctggatggtgggtcaccgcccagaactgggacttcccaggttctcatagtgattgtagatatcaatgacaacgtccctgaatttgctcagcggcgctacgaggtgcaggtcccagagaacacccctataggttcccttgtcatcaccgtctctgccagggatttagatgctgggacccacggggagctctcctattcattttttcaatactccaatcaaatcattcaggcctttgaaataaactcaatcacgggagaaattagatttaaaaaggcgttggattttgaggaaattcaatcttatcacatggaagttgaggcctcagacggtgggggtctttcaggaaaatgcaccgtagccatagaggtaatggatataaacgacaacgcaccggaacttactatgtccttacttatcagtgatatcctagaaaactccccagaaacagtggtcgctgttttcggaatttcggatccggactccgggaacaatggaaaaatgatgtgttccatccaagaccatctccctttccttctaaaacctaccttagaaaatttctacactttgttaacagaaggagcgctagacagagagagcagggccgagtacaacatcaccattactgtcacagacttggggacacccaggctgaaaaccgagtacaacataaccctgcgggtctccgacgtcaatgacaacgcccccgccttcacccaaacctcctacaccctgttcgtccgcgagaacaacagccccgccctgcacatcggcagtgtcvgcgchacagacagagactcaggcaccaacgctcaggtcacctactcgctgctgccgccccagaacccgcacctgcccctcgcctccctggtctccatcaacacagacaacggccacctgtttgccctcaggtcgctggactacgaggccctgcaggagttcgagttccgcgtgggcgcctcagaccgcggttctccggctttgagcagcgaggcgctggtgcgcgtgctggtgtgctggacgccaacgacaactcgcccttcgtgctgtacccgctgcagaacggctccgcgccctgcaccgagctggtgccccgggcggccgagccgggctacctggtgaccaaggtggtggcggtggacggtgactcgggccagaacgcctggctgtcgtaccagctgctcaaggccacggagcccgggctattcggcgtgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacytgcctctccctgaggcggccccggcccaggcccaggccgactcgctcaccgtctacctggtggtggcgttggcttcggtgtcttcgctcttcctcttctcggtgctcctgttcgtggcggtgcggctgtgcagaaggagcagggcggcctcggtgggtcgctactcggtgcccgagggcccctttccagggcatctggtggacgtgagtggcaccaggaccctgtcccagaattatcagtatgaagtttacctggcagaaagctctgagagccagttaaagtttcttaaaccggtacttcccaacttcttgggtgaagggactggtggggacagcgaggcaaactccaactctaggaatcattttgggttcaattaggaatctgacaacaggtcgtgataaatcatagaattcactattcatctgtaagttcccaattctctcattcgcgtagagtcacatattcacacattagtaatggctgtcatatttatagctatttcaacctgctggactattttccattccctttaatttttgttgtggtggttgtcagctatgttagttacagcatgtgcacacaatagcagagaaatggtgtttcctatggttgttgtttttgtttggtcagattttggaactcacaggtgttttcaggttcccagtatttgaacttgttcattgatatgttatgattaagagaatagtgtttcaaactttctggttatcatcagcatgactctaagtctatcgtaaatcacagcttttagcctaaaaaataattttcatttatgcaaaaattttagtaatcttgtaaattgttgcacttctgttgtgttgtttcaaaaacactactcttccctcaaatgaaccaatattttacctaggtgatgttttctctcctgaatttcttttttcaaaattgatatttatagaccatcggctgttattctaaaggattcaactcctgttacatgaaagaataatagaaaaaaggttggttgacttgtgattgctttttttttaataataaatggctttggtatgtaaataatgattctccttcttttaaaataatatatagcagtggctcacacctgtaatcctagcactttgggaggccaaggtgggcggatcacctgaggtcaggagttcgagaccagcctggccaacatgttgaaaccccatctctactaaaaaatacaaaaattagctgggcgtggtgacaagtgcctgtaatcccagttacttgggaggctgaggcaggagaatccctt

SEQ ID NO: 10762 - DNA, 13818 bp, Homo sapiens
gaggctgagatggaaggattgcttgagcccaagaagttgaggctgcagtgagctatgatggtgccactgcactccaacctggatgacagaacaagaaactgtctcaaaaaaaaaaaaataaaaaaaaaaaaaaggtcaggcacggtggctcaggcctgtaatcccagcactttgggaggccaaggtgggaggattacttgagcccaggcagtcaagaccagcctgggcaacacaaggagaccctgtctctaaaaaaaattttaaaaattagccaggtgtggtggcacatgcctgtagtcccagttactcaggaggctgacaagggaggatcgcttgagcctgggaggtcaaagctgcagtagccatgtttgtgccactgcactccagcctggataacagaacgagaccctgtctccctgtctcaaaatattaatgtgtgtgtgcgtgcgtgtgtgtgtgtgtgtgtgtgtgtgtgttttggtctccatcctggctcctggccagacctcctaaagcccttgtaatttcctaaatgataaagtgaagggagcttttgttattcataacaagctcttttcaaccacaactgagtttatgttagtaagttgacttttagaaagcccctaaggttggggtttgttgccaaggtaggcaactgtgtgattagagagttagaacttttagctccaaccctctgacctccaactaatggctattgaatcaagtatgcctgcataatgaagcctccataaaaaaaaacaaaaaagatgagggttggagagctgccaggttgatgaacacatggaggtgcagggaggtgcccagagaggacaagaaagctccaaatcccccttccccgatactttgtccggagcaactcttccatctgactgttcctaagttttatccttcataataaactagctaacataagtaaagtgtttacctgagttctgcgtgctattccagcgaattactgagccagaagagggagtcataaaaacagttaggaggcctggacttgtttgtgattggtatctggagtgggggcagccttgtagaactgagcccttcaacttggggattagataactggtaattatgggtagagtgtcagaactgaattaaactgcaggactcccagttaatatctaccaagaactgaagaattgattggtgtgggagaagtctccacatgattggtgtaagaagtggtgttcttggccaggcgcagtggctcacgcctgtaatcccagcactttgggaggccgaggcgggccgatcatgaggtcaggagattgagaccatcctggctaacatggtgaaaccctgtctctactaaaaatacaaaaaattagccaggcatggtggcgggtgcctgtagtcccagctactcgggaggctgaggcaggagaatcacttgaacctgggaggtggaggttgcagtgagcagagactgcaccactgcactccagcctggccaacagagcaagactccatctcaaaacaaaataaaacaaacaaacaaaaaaaactgagattctttgcaaagagcctggaataacttccttttagtcctggactataatgatgatgataaatatacctcgatgtaaccctgagatcccaagattcactagcccttgaataaaaaaaaggaaaaagaaaaaaacagtatattttttcgttttgcaaatcacagttcccttattaagatggaattgctgccaattacagagaagctatttgcctaagccaaaaatccatgaggttcacatggacttatagttacacaaattagaaacaaatgttatatttaaaaccatagagaaatgcccaggtgatgaaagctggggtgaaggagtctgcacattcatttcaaactgttaaaggatttgtgggccatgcaatggtcccttgcattagagaagtcaaagagctttgtgcaatcctctcctgtctgtgatctggaagacacgtgctcatcacagagctccagctgctccgagactttactcctttcttcagctgcacgcactgctctctcgcttttgttaggaattgactaattcctcctcttcctcttcctcctcctccttgccatctctaggcccagtcagcatctcttgttcatcctctgatcccatgtccagctatggttctggattcaacactagcagcaacagtggcgctgactccactttaggatcaataaatatttttctggctaggcgcagtggctcacatctataatctcagtactttgggaggccaaggtgggtggatcacaaggtcaagagatcgagaccatcttggccaacatggtgaaacctcgtctccactaaaattacaaaaattagttgaacatggtggtgcgcacctgtagtcccagctacttgggaggctgaggcaggagagtcgcttgaacccaggatgtggaggttgaagtgagccaagatcgcgccactgcactccagtctagcgacagatggagactctgtctcaaaaaaaaaaaaataagtatttttctttctagccgtatatccaccttacatggtccctcaactccccaagcccactctgcctgccccatctcctccttccacatcctctcctcaacctagcacttggttggcaatgccttcctcgatcctctgccaaagaccctctagccagtgcttaccctgtctgttctctctctttacccaaagaaatacataaagtttgaccagaatggaaacagagatatcagtgaaaaaaggtgatttggggaagtgtgcaggcctaggaagacagaggcttgttcctttgcttgcttaaaatctttgatcaaacggccaggcgtggtggctcacacctgtaatcccagcactttgggagggcgaggtgggcgaatcatgagatcaggagttcaagaccagcctggccaacatagtaaaaccccgtctcactaaaaatacaaaaaattakccagctgggcgtggtggcaggtgcctgtaatcccagctactctggaggctgaggcaggagaatcacttgaacccgggaggtggaggttgcagtgagtggagattgcaccactgcactctagcctgagtgacagagtgagactccatctcaaaaaaaagaaaagaaatctttgctcaaatatcactttttcagagaacgcttctctaaccactctatttattttattattttattgtattttttgagacagggtctcactctgttgcccagactggagtgtaatggcacggtcatggctcactgcagccttgatctcctgggctcaagcgatcctctcacttcagcctcccaagtggctaggaccacaggcgtaagccaccgtgtctggccagaccaccatatttaaaactggggacaagtcaggctcacacctgtaatcccagcactttgggaggccaaggtgggaggatcacaaggttaggagttcaagaccagcctggccaacttggtgaaaccccatctctactaaaaatacaaaaattagccgggtatagtggtgatcgcctgtaatcccagctattcgttaggctgaggcaggagaatcgcttgaacccgggaggcagaggttgcagtgagctgagattgtgccactgcactccagcctgggcaacagagcgagattctgtctcaacaaaaaaagctgggtgcagtggctcacgcctgtaatcctagcactttgggagtccgaggtgggtagatcacctaaggtcaggagttcaagaccagcctggtcaacatggtgaaaccccgcctctacaaaaatacaaaaattagctaggtatgatggcaggtggctgtaatcccagctactcggaaggctgaggcaggagaatcgcttgaacccaggaggcggaggttacagtgagctgagatcaagccattgcactctagcctgggcgacagagtgagactccgtttaaaaaaaaaacaaaaaacaaaaaacaaaaaactggggaccattggcaataatactcctatgtcccctcttccctactttgttttcctccataggcacctggcgccttttttttttttttttttttttttttgagacggagtctcactctgttgcccaggctggagtgcaatggcgcgatctcagctcactgcaacctctgcctcccgggtttaagcgattcgcctgcgtcagcctcctgagcagctgggattacaggcacgcaccaccaggccctgctaatttttgtatttttagtagagatggggtttcaccatgttggtcaggctggtctccaactcctgaccttgtgatccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactcccagctacagaaaaggaaatatgttgsggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgcgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcrgcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttaagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttac

SEQ ID NO: 10763 - DNA, 25120 bp, Homo sapiens
gatactttaatgtgagccacccacatactatccctgtgtaaaaactaagaaaattgagacccctggaaagaacagacttacccaaagtaaagcttgcccaaatgtatagcaaagctagaatgaaaatctcagtcagcctaaactcagggcttcttttgtcgtctagtggctgagggagttatgaatgtgggtcacaggtgaccgccgcatttgaagaagagtctgtaagtgaatcgacttgcggaacatccttgaagccgacagtgagcccgtctctgctgccctctggtggccaggcagatccatgactcccctctcctgttcctcctgccctcgccggatgcttgtttttccctctcctcagttctagcagcttatgccttgttttcccgcttctcctggaggtggactctagtcagaatgcagagattgtgactcctttttttctctcccacacaccaacatcttcctgcacaaaatggcctcccataatatgtagcataatttaggacacagttctcagcacaggcagacctctgagaaagtgtatgcagatgatttgtgagaacacacacacgcgagtgtaaacggagcttctttacgcggtgagttggcgctgatgtgactgaccataaaaaattcaaataattgcagcatttggtaccatagagatgatactacagaatgcatgcaatgagcggcatcttttcacacattcaggtgtataaagtaaatttctatattttcctattacggattttaatttgtatgccaagcattatgatgtcttctgacagaggagttcatctggtaatttccagataaattcagtggctttcacacaattaatttaatagcagcctcttcttcacccgccgtgtgatttctaagttctgaggtgggaggtggtgcagggctggtgtagaagtctctcctcacatttgcatcatcagctcccacaatatgtcactatcccatcgtgtttcctggtcgtcactgtccttcccacagtggtgacgatcactgttatgtccttgatgccactctcctcttgctggaacattccatcccagcattttaggcagcaaactttcatcccactgttggagccttccagagtctgccacttcttgccttggagaacttttcctttgctgccactctgagagggacatctgtgggcatcgctaccattctgggaaccggaggtgaagtggggttcattcccctctactccaattgagagagaaccagggtaaagagaccctcctatcctcgtccatgtttaattgtttctcttctctccaaatctctcatcctctacagtgaggggagggtctttgtctagactgaaggatggagggggaaacccttacattaagaatcgtaaccgtaagtcaggggacccaattatgggctgctcataacgggagggaaagaaacttaaggaaaaaatcggctcaaaccttgtaacatcataatgctgcatatgcttttattattacattgacatgaaaatctgcaattaaattaaaaattgttctggagaactcttgaaatcctgagactatatctgagaccccctctagctcaaggaacacagacttaaggggaacgtaaaggaaaatctggcagaaacaaaaacacacacaaaatatgcctatcattatactcttcatgcccaaatattatgctgagaaggttattacatttctttggtaaacatctgagagtaattaaaccttttattactcagcaaagggagataaagtacctgagtaaaaagagcaataaagtagcccacaagggaccttggcccagagctctgatcctggagagggcagttcctttctctgggtctctgttttctcatcagtggaatgagggatggcacgtttgatattcagttttgcttccaactccagcccgatgagtgccatgctctggtggagacttggcactagttgggaatctttgatgtgtggcaaggtggagggaagggtggatggcacccgctgatgtgtgggacggtggggtctgtgtgaggacctaactggggggttgcagatgaggcctccatgaaggccttggctttctggggaaggtgagaattgccagtgtcatgattttgtgtgcacgtctgcagaattcacaactgaacccagccaaagtccacttgtccccggagtttcactgttgagaggattatagctgttaggaggtgaatgtgctattctgattttcggaatgcaatctcattttcacagggcctccgggatttggctctgccttcaactggggtgagacggcttaaatcctccttcacccaaagtcctggaggaggcctccacactctctggctctcccacactctctggctctctggtgtgtctttgatcagcacaccccagggctctgacctgtttctgaccacctgctatgtggatgaagatacatctggggccaagtgagaagacccagtagcaccaggtttcgccccaaaggagagagggagacacgtgagtggtttggattccctggtgaaggatggccacgggaagctggggacattgtctcagattacagagtaggacatacggacggaatcaatgtcctttagggaaatgctgccacctgttacactgcctcccacttatatttatatcccactgtgcagtcttcaaagtgcgatcgtagcccatttgaccctcacagtgttctcgtgaagcaggctgagtgaggaagaagcacgaaattaaaaacaagaaaaccaggatcacattttcatttgtcatggatgatgtggggcatgtgtccctgagccttaacgtcttcttctgtcacatggtcatgacacagcttggaaaacgttaggatgattgtctccaccacacagcagagaaaatacaggctcaagaaagtaaagaaagatgtccaaggtcacacacacacacacacaaaaacccaattcactttgtctcctagaaatcttattttagctttctctataaaaatgtattaacatatgataaactatagctgtttttaatgtctacatagatacataagctttcgacttcgtgaactaagttaatttattcttaccagtcagttactatggctgcttggcattttgaggagcaacatttgaggcttttactgaaaaaagttctaatgacccatgatacgtagtaatttgcaattttctttgatatgagttttagcagtgcaggataggccttgaaattcagaattgttcatcatctaatgcctaaacataagctaccacttattattacaatttaacacttaaactttatccagaaaattaaattaaattaaacatgggtttttgagaatttgatgatacatttgcatattagatcatatatcttgacaacaccaaaatttactatatttaataggaacagcagtttcagaagattcttgcattacatccaaatagtaaaacggaggggtcaaaagcttatcattttaaaaggtttttacttaaagatggcaatttaagtctagttatctattttcaaaaaatgtgccaaagcttttcagcatcctgacagcaaaccctgtggcagggcatttcctcggcaccaccrgccttctgggctggatgactctttgttgtgggggctgccacgtgcctcatagaatgtttagcaacacccctggtttctactcaatatatgtcccctcccccagtcgtgacaactgaaaatgttcccagacattgccaaatgtcctctaagggcaaaacagcctctttccccattaagaaccctggtccaaggtggttatcctccctgatatattctctcacaatctatctgagcactggagatggattctcccaacattcttcgaaagcttcattgatttgagcaatttttttgagagttcacttgtagattttccctcccaccgctttgacatgaaagacctacaggaacacaagcctctgaagtggtctgtagcaagtgtgagttcattttagttcacacggctgagaaatcatgcttggtatggatgttgtggggctttctttactcttacttggtggaaaaaaatgttcctgcttttcacaaaaggagtcaagggaggcatcagcaacacccttcagtctaaggggaggtgactggtaagtttcaggtggcaaggtgctcatggtctgcactgtcttctaacacccaaccccattttcacataaatatcatactgcccttttcgatctaggtattgtgaatgggctcatataagtttccttaaagatatcttatatgaaagtacatattttttataaagcaaatgggcaatatttgtgtaacaacaatctcctgactcatttgattgttaaatctccatttcagaatgttgatttttacccctgtcccataaaatcttactagcagtagtttcttggaaagggggaaactgtaattgacttgacattgctcctgagctggtttctctactttgtgtgaagcaagttttctttcaataaaatacttgacacatcacatataataagtcttagacttctttcactctgaagtttgtatttttcaatggtaaaactagccttctatccttgtcctggtaagttttaaagtttttagctgtgtgaagtatttttgttcagctgggacagtggggttgctgggtttgccagtttctgccagttgggctttttgtttttttaattcattcgtgtttttaagtctattctaaaaggccacttacagatattttcccgactatctttctactactctttctttcactttccacggcatctctgtgtcccgggttctctgagcgctagcactgaatgttggctttctggctgcagtgtggagacgcagagccttcctgccctttcctccatgtgtagaaaacagtggtaaagaaaggctttgcaggaggagttgggaggaggacaggaaaaaatatttgaatcttgctctataagttttgcaagctcacaacagatgaacctaaggagttttgtttgctttggtttggtttggggtttttttaatattattgttcctttacctcaagtgttttttcatttcagtcacaagacttccttacacctaaaaaattgcttaaaatattgtctcatgaaattagggttgttgaggcaggaataatttcataaagttctattggaaggcaaatgtcaggactgatgtaggaagacacaccaacgaagttgagggtggtccaaagtctgttacaagttggaaggcttttgtaaggaagttcaggcagaaagaaaggggctcttcatattggagttgtcttttttcactggagggtacaatacagaggttacaatcattggacacagatgacaatatatagactaaaatatttcatgcacaaaacaatcagtaaaactttatgattcagaaacaaatccatatccttttcgatgtcaggaggttacatattaatcactacatcaaattagctcagaagctacattgaagccgaactacatcaatgtatgggtgtatgagcagatcgggttataggttacagaggtattcttcaatcagacgttatcttatgtgtaggaaaaggcaaggactattattccttatcttttaaggagtagagtgactcaggcaagagagatgggaggccgtgtgctcaatcttgttttgtctttgaagcatctttctggagaactgcaggtcatcacagcaggggctttgtgaaagtatgctagcaagccgaaatgagcaagcaaggcttcttacatttgctacattgtctcacaatataacacgttaggtaaagggttggatgtgatcagtaattgcagagaaatggagccaagcccatttcactgactgtgcaggggttgatgtggattctctgctaagactgcataaccaatggaagccatggagtgtgccgggtgtgtcacagcctcacttaggcacagcgtttccttgtctttgttccagggaggatggtggattttccaggctacaatctgtctggtgcagtcgcctccttcctattcatcctgctgacaatgaagcagtcaggtaggattcccttctccctttactgtatagtctaatgtcccagtgagctagtctgggtccaaaggtcgagaacaacatctaagagtgtaagtctggggccaagccacctgtatccaaaaaggaactcctcacttttgaggagctcctccactcccaggagctcctccactcctagctgagtcacctttggaaagttactwgagcacctcataccttagttctttcatctttttaatgagaataacagcagtaactacatctcagaggccagcacaggctttaggattaaatgagacattaaaagcacttgaatcagtggttgcaccacgttaaattattaattcactctagtactttggggtcaagaaatgcagctgcttcttatcataaattaagctgcaattaaaaaaaatacttggaaataagaaattagaagaaagggactttggaaatctcactagctgaattttgacgtcaaaatgttgcaccttgaaaaataattatttaaaaattcagtgtcaaaaaaaaaaaatcagtgtcagaaggagatgtcagagccctaaggaaaatgcagcatggcgaagtgggaaaaaacacgacacagagcatcagagggcgcaggctctgcctcggcaccgcagagctggtgtgtctgcctcggtgccgcagagctggtgtgtctgccttggcsctgcagagctggtgtgatgtgatgaagctgctggcttctctgtgcttgtgctgcagctccctaccctgtaacagtcaatctgatggaatgtcttcagttctagcttcatatttagacttcatcaatgaagaatacaagcagatctccacttaggctctttagccaccttttgagcagcatctatttgatacccagcagcagctaagtagggtgaggttcttcctagcaggattggatctgcacagagaaagagcaaatggccccggagcatttagaatgagaaagaacatatcatacatgacataaaatgatcaaacataataacatacmtaactgttaaacatctcttcaatttgcagataacaaggaagagatcagacatgtcttagaatttgtttggaagacccaaaaatctctagacaaaccagtgtccttaatccagcacaaaatgtccttgtgaaaactgcattgtacatagtcccagtaattggcctcctgccaactccagacgggaaaaaaacaaacaaaaaaaaaamaaaaaaaaaacagtttttatatctaagagaagaggaatcctgaaaggctaaaaaaagctaataaatggatttattatctaaacttcaggaaaataaaatgttaataacaagaataaggtttccaatttaaaaagtcaatttacatgagaataaatgactcaaggaataaataatttacttgagaataaaaacaacccaggtatgctggtattaatatcttgaagatgaagaaattaggacttcaaatctcaaaatcttaccaagagtaatagatttgccaccgaatcacatagctggtaggtgacagacagcaacctcacccacatttttgaactgcatttgttttcagtacacaaaattgactctgtaacaaacagatgtgcaaatcatcatgctggatttctctaaaacattaaacatatatctctccctcttctagttgcctccattttgacaggctggacaccccaaagcatgcatatgattttctgattggcatttcctcgttcctctttttcacttattttatagaagactttagagtcattggccctgctcatcctatcctggccggggttggggaagatgccctgttaacctgccagctactccccaagaggaccacaatgcaygtggaggtgaggtggtaccgctcagagcccagcacacctgtgtttgtgcacagggatggagtggaggtgactgagatgcagatggaggagtacagaggcwgggtagagtggatagagaatggcattgcaaagggaaatgtggcactgaagatacacaacatccagccctccgacaatggacaatactggtgccatttccaggatgggaactactgtggagaaacaagcttgctgctcaaagtagcaggtgaatatctggggaaagacacagggtctcaagaggcagagatatattaatttgtggtaagctttgtgacagttgaggaaatccttttgaatcatcaaggtaattcctaatgcttagtcctctaccctgattgatttaaaaataagtggttctggagtcttcaagcttagtgttaaaatattttcccaaatttaatttgcacagttttgactgttcttgaggattatttggaatccatgacatgcagtctttagcaattttgctgagacacacatttgtgctacctaaggctggtgcgcaagagcaaaccaattgctgcatgaatgagcccagctgacgtccggcatctgtatctcagggcattggtttttctctacccaatcccatctatgcagaaactgagacgtgaaaatgttctttccttgtgaaatgccctcagttagaaagctatcaacaagactgaaaaggctaagaatgtcgtgctttggagattgttatatactagtgttcaatgaattggggactcacagatgcttttggacacaccctctgtgaatgggaaggttcttcatattgctgttgtattagctaagcaggaaggagtagggaagaaggggacaactgaagaatggatctgtcttatgaaaagtaaactatcatatgattccctgacagggctaacttctccatgctctaaagagaaaatcaagtaaatccaattactaaggcaaatggggaaaatagttctctggagatgttaacgtctccagctgatactgcttccttctttacttccctggraggctgtttcctaatacctttttttttcttaacatccattactgttactgtgttcaaggtgattcaaaatggatggaggaatacatatatttctgacatggggggacagggaacgtactgatgtatttcaatatcaggaacatttacaaataagtcacacattttctaagggtccaagggaagggagtggatctctcttttaccagcaagtgattaagacagaattcccatttatggaaaatatagtccccttagtttgggtgtgggagtttcacgttaaatagagaaaaaaaatccatgatttcataaactgttgtaaactaggatttctcaaaaccatcttacccattgaatagaatatttagctacaaataacgcctcgtggagattcgcatttcacatgctcccgtttatccacttgcttccgaagatcacagccaccagcaaaagatgcaggaagaacaggcccctggggagtgatttctgactttgtgttaaatcttcaatcaaattggagttcaagacatcatctaaaataccagacaatgtgcccaatacagataattttaagatgaaaaaggcagagttcatggcacagaggaattaatgaataaattacagctcatctctgtttgcagtgctagargcrttgcaaaatgtcatgatgtcccccttctccgattcccctttctggatctggagaaaagtactggtcagatgctaaaatgtaaagacscagactggggaacaaataaagtgtatctgaactcacatttgaatggggagactgaggtcgactttctgctcctcagactcctgaactccggccacctccctgtgagcaacgtcactgggatctcagcctctgtgatttctgcctctgtgggctctgggtgtcagagctgtggcttccctctgcaggtctggggtctgcccctarcatccacatggagggacctggggagagtggagtccagcttgtgtgcactgcaaggggctggttcccwgagccccaggtgtattgggaagacatccrgggagagaagctgctggccgtgtctgagcatcgcatccaagatraagatggcctgttctatgyggaagccaccctggtggtcagraacgcctctgcagagtctgtgtcctgcttggtccacaaccccgtcctcactgaggagaaggggtcggtcatcagcctcccaggtcagtgctctgcctctaggacccacaygctcagatcagcaggagaggtcccagggactgcaccatagcacctcgtatttttatcaagagacattrtctatcatatagcaatatgtattgaaagccataaaacatttatgactrgaaatatacgcactacattttacttgaatagctgttatggcgcctgcgttatttttgagttctacctttccttcttctgcattgattgtttttactcacaagtattcattgcattgtaaagaaaataaagctatatttcttcaactgaaatgttttcctatgctgtcttgtgctgattacttctagaaatctatcatatgaagataatcagagatgtagamaactatttgcataatagaatattaattatggccttatttataaatagcagcaaaaacaaccaaccccccaatacaacagtacagtgtggaatcttgtcttactatacattatagcattaataaaaagatatttttaaataattttaatggttgaaaaaaatcctcatgatgcactattcaatgataaacatgacatctacctataaattgacatttccaatcacataaaagttactggccttaaataacttataactgcactaaaactttcaggataccctccacatttggatataagtatacagttattcatataaatggatagattaaaaaaactttaaagttaatgttacattttaattttaaatgaagctgattgtatattacatataattcgtctctctactttgtaatttaggtgatactgtttatgtccatataattttgtactttctgtgtatctataaaaggaacatatgttattttcatgctgatagctaagtatttatgctgtaaatatcagaagaaaccaacagaatcatggggagatagaagtgacagcatttttgttgtgcagagaaaaggaaaaaaagctgtatcattgggtaatctgtgggaaagaatcagtatttttctgcatttcatttttttaatgaattgagcttccctatataatgtataaattgctttcttttttaaaaaatagtttctctcctttcccttacaccaaattccttaatatgttrttcttgttctttttccagagaaactccagactgagctgggtaagtacgaggtgctggcacacacctgtggagggagcctctgccctccccagcagagggaggggagctaccacgagaccatgtgacccagaggaaaaactgaggcacgattttaccaggtcctatgttcattaaataccagaggagaccagcaaagtaatggcctcattcaaggaggttgcagctgtgttacctgacactttgggrgctcatggagattccagtgagcatcagatggacacctataggaagcatggcatcatctctgttctatgtgttgaggggaaagggagctgcctcagaatgtgtgggggatgacagcagacagctggccggggcctggaggccctttgaaaacatttcaagtgtgaacaagggcagcatcattatgacaacctgggttgcacccagcacctccctgctcaactctgctatggggtcctgcacctgctcctcaccccagtacacccctaagctaatcactattgggagggagctgttactttctgagtgcaacctgggatactgtgagtgtagcaattttttttttttttttttttgagacggagtcttgctctgtcgcccaggctggagtgcagtggcgcgatcttggctcactgcaagctccgcctcccaggttcaggccattctcctgcctcagcctcccaagtagctgggactacaggcaaccgccaccacgcccggctaattttttgtatttttagtagagacgagatttcaccgtgttagccaggatggtctcgatctcctgatctcgtgatccccccacctcagcctcccaaagtgctgggattacaggcgtgagccaccacgccgggcattttttttttttttgagacggagtctcgctctgttgcccaagctggagtgcaatggcgccatcttggctcactgcaacctccatctcctggattcaagctattctcctgcctcagcctcctgagtaactgggactacaggcakgcrccaccacacccagctaattttttttttttttttttagtagagacrgggtttcaccatgttggccaggatggtctcgatctcctgacctcatgatccgccggccttggcctcccaaaggtgcwgggattacaggcatgagccactgcacccagcctaatttttgttttttaaatctcggagttggactgagggtattattttgctgcacctgagataagtggtttaaaacataaccagccgatgkctgagcccctttgagtttcccctttacctccttactagctccctcctttttatggcctcttctcccagcccaaggcaaccagcctgcctccctgcctaggtgcatagaacgtggatcccttatgtgctctttccatcaattccttgctctccatcaagtcacctgctccaggaatgtgtatccatgtgtgtgctttaggtgagcttaagcacacctttcagcccacraaagagtttttgaggaaaatcagggtaacaaacacaacccaatctctaccagagtctactatggcaccttcaaccccattaggccataaacataaagggaagggtccctggaaggcgcaaagtaactccacaatctgaggagagacacacacctgtgtaycttacccttctgagatcaggaagtaaagccagtgtttggggcaggttgacacaagtctgtctctcaagaaggttttaggrgaagagtcactcctctgagttctctgagacccactggagacccagcacacamaatacgaccccatgtccwgttgttcctaagtcatggtaacctccggggccacaattaaccaacacggaaagayggagcttccctttgcttcctgtcaggtgggagaggagggctctgggcacggaagctttgcaggtgagctctaatgatgggacacccagctctctatggaagtcctaagactgaaatcactgcttgtagtcttacaaataatgtttttcatttataaaaataatagtttttaaaaatattaattgtatgccaggcacgatgctgaatatgttatgggaattatttcattttttcttacaataattataaagtttaattgctttatcctcatattacagctaagaaacaatcttagagacatacatggtttgccaaaaatcaggaagaaatggtgatgtttaccttctaatctacatctatctaacttaacagtgcaagtccttaattacttatgtgtgactttgtcagctcattcatctctatttttctcatctttaaagtgaacaggttgaatttaatctctaatgtagtgtccagttctaagagattagatataacttagcatatttgagaaatgagatagtgcattaattgaatatgctgattgaaagaggattatgtggtatgatgatgagattatcaggtttcaaggaatcagtgtataattcagtgtacttcacgctccagaagggaattaatttttcagtggatattcagaaggcattcagaacatacaaacaataaccaaaacaaaacaaagcaatayatttcagcacaaaattgtctggaaggctgtgtacaaaaccgtatagaaaaaggaggttaactactgcatgttcacacttataagggggagctgattggtgagaacacatggatgcatggcagggaacaacacacactggacacctgttgggggatgggggagggagagcatcaggaagaacagctaatggatgctgggcttaacacctgggtgatgggatgacctgtgcagtaagccaccatggcacatgtttacctatgtaacaaacctgcacatcctgcacatgtaccccggaacttaaaattgaaagaaaaaaaaagtgggttaggcatagtggctcccaaggagcttgtattctagtagaacatcaattattaacaaacagggctgcatgatttttttagcactttaaactttagttttacttggattctggacaaaaggagttttgtctgtatctgtaatgcatcaaattaattgaatctccatacttacattttgcttccttcagtctccattgaagtcaattttagctcttaattacctatgtcaggcagggcaagccagtttaagatctaatatgtgcacaggtcacacacggacagggaataaaatcctcatatggataaaggagatgaggaaacagtctgttttattaagtaatttaccgtaagccatgtggatgcagaaacagccccaaactaatccctagtccattttttctgattcttgtcttcagactttaatagatacataggagaggaaaataatattgttttaggtaaaattacaggacaaagcaaacaaaatgctggaaataactgggagtcaactgttacctggaatggaaggtaataatctgaaaattcaaattgtgttgacagggactttcctctctacaaaggtagctggcagttttcggccaatgacataatgggatgttaacgcctttggccagtgactctatgcagagaaccaacaattttatgcttgtgtttctattataaatgatcacaccttatgcaaaaccattcttatcatttaacagaaaaggacgacacttaatttagaatagagaaaaaatggcacgggcagggcctgatgagaatggaaaatgtaatatagcttgggcccaggaaagccctcagagaacatctttccccactttgcacagtgggagaattagaccccttttttacattcatcattgtttcacaatttgtactttgccgacttccccaattattgatcttaaaatgttaattttaattttcaaaattatttgaggacattcaactggtgtgtgtctataactccacctatgtggagcattggggaaataaaatatagcggctggaccagacttacaaggtactataaagtccacctagaggaaagcttcttcaaatatcattaccaaaagtccacatgagacacgtttttaaacccctccctattaccacgtcagagggtggggatggctccaacgccttcaagtctcacaggtctgtgcacctctgctcacgctgcagggtcttccaggcacttaatgcaaactattttgttcaactctgaaacattatgattttggtagttgtatagcaaatttacagtttaagaaactgaggcattaagaagtagtttaagacagattaagaagtagtttaaaatcatacagaattgaagtgttagaagaaaaactttagacagactaaatttagcagagtctaactgagaaaaggatgactcataaacaagccatccctcagaatcagaacggtttcagagaattcaaagcagcaatttggtcagacagcatttatggacagaaaatggaaatgaggtacagaaaacagaagtgaggtacagagacagctctattggttgcagcctggcgtttgccgatttgaacagggtttcaacagttggctgcctgcaactaacagaagtgcagcagctgctactcagctatttattacaaaagtgtactcctaagttagccttagctcctaagttaggcttattcataaaataattttgcaattaaaactctcagaataaaatgagcaatttataaatttggccccaggatgcctctgtacctgagtgcttatgtaacaaactgcaacctaagttaggctttcagtagttgacgtactaagttaaattgcagtttgttacataaggagtcaggtacagaggcatctggggccaaatttataaactgttcactttattctgggtgttttttgtttgtttgtttttaaagtctcgctttgtcacccagcctggagtgcagtggcatgatctcagctcactgcaacctctgcctcccgggttcgagcaattyttccacctcagcctcctgagtagctgggattacaggcacccaccatcatgcccgactaatttttgtatttctgtagagacggggtttcaccatgttggccaggctggtcttgaactcctgacctctggtgatccacccgcttcggcctcccaaagtgctgggattatagacttgagccaccacacccagcctatctgggagttttaattgcaaaattattttattattggtctgtaaactgaaaaaaatacaggtagaagcaggtagggattcaattactgttttactcagactgacacacatcatggaaygattcctccttaaagaagagcaacctctattctgagtccatgaaacccccacctcacctaaggatgaccytgagcctcacagcaaccctgggatgctcatggtttctaaactccaatggagctgttcttagagatgacattrttggttccattttgattctktcaytgtgttttgtccactctatttaacagcttctttaaaagtgaatggaccttcccagcccatcctcgtcagagtgggagaagatatacagctaacctgttacctgtcccccaaggcgaatgcacagagcatggaggtgaggtgggaccgatcccaccgttaccctgctgtgcatgtgtatatggatggggaccatgtggctggagagcagatggcagagtacagagggaggactgtrctggtgagtgacgccattgacgagggcagactgaccctgcagatactcagtgccagaccttcggacgacgggcagtaccgctgcctttttgaaaaagatgatgtctaccargaggccagtttggatctgaaggtggtargtaagaattctagatagatattttgtattcaatacctgctcytgccactttaatatgctagttcctggacaatttctctgacatttgaaattttcttaatgctyattcatcatcaaatttatatcaaatcctccagtgtgtgaaactgtcatagttacttaaaatccacaaactcamatggatgaaatttaattatttgggcatataacttgtatcttttccagtatcttcaaaaattgaccatatctttaaggaaatctgagtatcttactacatattttacaaaagrctcattgtttcacagtgtgttattagaattctgagaaatgcaataaaattctagaaactgtaatcatctgaagactaaactggatccactgtgtaaaccaaaattataaatattgacagttttggcagggacaggggagaaaagatgaaatcactccctgcagcatcatttcccactgtccgtgtgtgtgagaattgaaacgtccaaggttagcagatgccattgagtacatataggcccaagtcttggatatgctacgtgtttctcccacggattttgattctaaattaataaacacgtttagccatgggrgcgcatgttgagaagtttcatgagcctcgtattttctgccattggacgtagatatttataaggtttcgatttttgagaatatcctcctactccgtatgttaatcctgtccatgtgacccatgccctggccgaagttattttgttctcagggacagaataaatgttggatttgaacatttaccttacctcttaatcatcccagaatgatttaggaatacaaagaataaaaataagcaaacaaacaaaataagaaaatgctccagccagcctcatccctaagtggartgcaatcccccttaagcttttctcccttccccaagccctccacatccccttctttcctcccagtgaaattgctgcccactcatccacttgaaaggaccccaggctttggttgctttctctgccccaggtctgggttcttccccactgatcactgtggaggggcaagaagatggagaaatgcagcygatrtgctcttcagatgggtggttcccacagccccacgtgcmrtggagggacatggaaggaaagacgataccatcmtcttcccaggccctgactcaaggcagccaygggctgttccacgtgcagacattgctaagggtcacaaacatctccgctgtggacgtcacttgttccatcagcatcccctttttgggcgaggagaaaatcgcaactttttctctctcaggttggtgattccttatgttccttcaggtttggaaaataaatatgaagaccaactcagacttactcatygtattgctcttcttcctttktgatttttatttgctgmtctctgacgaggtctcctgctatcctctgcaaagctggttttcaggacacccagggattctactcctctgagtttctctctgacaccctcaactagcgccctgcaattatttttatcattggatacacactaaattctcgtaattgaccctgttttcactctctctctttaaattctcttcttctgatgtgaaaacaattaaattacagaactttgtgttttccccctcatggaggattttcttctggattagaaactgatttttattaataccatcttcatggttgcggcttgagtaattttatcctttcctcctcaagtcattccagtgattgtgtgatatagttggaagagagaagggaaaacttgtctgtgcatgtgtacatttctgagacgagcaaacatgaaatacttgcattctctcctctgcatctccagagcagggaggagcaggccaactgcttcctgggaggccaaattctctcccttctctccagcctagaagctgctcagatgaaaagtacaatcttaatattgtcccagtttcacagtttcaagggattcttgggtttccattttagagtccaggatgacgtttttgtggaaaacactgcttgtttggggattgcttcttgctgtggctgtaggcctgcccaggaagaggagctgaaaagaggtaagtcagggaaacagaaacagcggagcacactgcagtgggaaccgtactgcgtacttccccgagcctcccttttcacaagtcacctatgggaggcagtcagtgaatatccagtaactaaggaaacatgagaaacaggaaagcccagggcttatcatgcaatccaggctcagtgatgcatgaggtcagtgtttccacttgtaatagaagcaaaatgattaaaagataatgatttgatttcctgctgcccattccccagtgatctggttagggaagaagaagaaaaaagtgagtagtacagccatccttgttttcaaggctgagagctgagrttcactgagatttgttggcgtgaacaatttcctatgatctttaaaaatgtggtgacctacttgttggtgatttctgtgttgctggtgacttctcatgtgttagggaggctgttttgtgtgctctagaaagtgcttccactttaaatttcttatgtccgtgaaacacttgtcttcctgtttggctgttaatagaatgaaattatattgattaattatcagaatggattctctttctttacagtgaatgtgacattggcttcaaacacagctcacctgaractgatttcttctgaacagaacaagcgtgtgatccatggacattcaggcagccagatatcccacagagatctgactatctgctctatgggccagagggaactcctgtcagggagctggtactgagaggtggagactgggaacagggcgcgatgggtcccggaggttgccaagcacatgttgcaaagaaagagtcatctctgtgtcacctgacagtgagttttaggcaatggattgcaaaagaaatgagttctgggccatcccctctcttccaagccccatccccttgaaggtggcccctgaacaagtcagaatccccctgaccgtgcctctgaatacctctcctcttataacatgattggcaagtgccctatctacaccttccccaaaacttccttctctgggactctgcaccccgcttcattctttggttccctaatgtaggttctctggacattttttctgtacccacaagaacatctccaacgtatcaggaaaataacaatctgggattctggaaaccagaatgatattctgagtcctgatcatttctcatttctctaactgcttgaagggggctgccatgatcattgaagtactaactcaaggtgttttaattctactcaggaaaatctgctggagactgatcttttcagagacctatcctgttccaggttctctgagatccggcctatcaatcacaatctgacatctgataatcaaggacccttagaaaatcccatgggaaatacaatttagcctacaggaagaaatgaaaggaataatcaaggatttggtcagtttcttttttttttttttttcttttcttttttttttttttttttttttacaaagtctcactctgtcacccaggctggagtgcagtggcatgatctcagctgactgcaacctctgcctcccgggttcaagcaattctcttgcctcagtctcatgagtagctgggattacaggcatgtgccaccatgcccagcctatttttgtatttttagtagagatggggtttcactttgttggccaggctggtctcaaacttctggcctcaaatgatccactcgcctcggcctcccaaagtgctggaattacaggcatgagccaccacacctggcctgatcagtttatttaagatggtgacaattaattgtccacataggtggaactgagaaaataaaaaatatatatatacagttaaaaaaaagtgaaagaaaatacagctgcataagggggagaaaaatctgatcactaaaatataatcttgaaaatcttatgaagtgttgtaaaatccctcctccagactttttgagaaagttgatacaggaaattgagtcaggaaaaaaattttagactttccgatccaagcgaaaaattatgtatcatctatacgaacatgtcaattttattgttagagcaaaataaagtgcacaatttaaaattaataattataaaataaacaaatataagcagtacatgtaacacagtaaaaatattttaaagttataatgagttcaagaagataaactatatgtggaagacagaagaatgtcaacaagacttttggaaagaatgttatgaagtgagaagacgaggacctgctagtgacgctctgctgctctccaggatggcagacgtcagaggcatcgcggtcccatgcggatcactcatgaacagcactctgaacttgctcttctgggccatcatttttttttctatttttaaactcataaatttaaacacataaatgttagaaactacacattattcttccacaaatgtttacacattaattttaataaacatttttttcaattgtggtaaaatacataacataaaataaaaccctttaaccattttaaagtgtacagttctgtggtattgtatatgtgacattgctgtgtgaccatcatcatcactttctagttccagaatattttcatcgccctaaacgaaacttcatacccattaagcagttactacccatttttcaccccctactccccaggtaatctactttctgtccctatgaacttttctattctgaatattttatataaatggaaccataaactatctgtgtatgtgtatgtgtatgtggcttctttcccttagcctaatatttttagagttcttccatgtcatagcatgtatcagtgcttctttcctttttaaaaaaaaaattaacagacattatttttaagaacagttttagatttataacaaaataaaatggaaaatccagagagctcctagatccctcctctctcccccctatttctgctattattaacatcttacattagtgtggcacatttgttacaacccatgaaagaatagtgacacattattttcaactaaagtccacagttttacattaggttcaccttttgtttatataatctctggagtttaacaaatgatttttacatttacattgatctatctttatatttatgaagacttaaatttattagtaaatatactaggtttacctgaaaatattttaacactattttgatttaatgtaattaaaaataatttattgcacaacatctaaaggttaactattatttttcacttacttttgagtcttccttcctagtgaatgtagctctttgcttgttagtctgtgcttgtgaaggccctatgaatacatatattcactttccagggagaaagtctcaagaaaattggttttatcagtcacattctctcactgtatattagaaaacatactttcctatagcttcccaaattggtgattaatgtactttctgagttccagttccagttagaaaagccacaggaaggagaggggttggtggcgttgaggatgatgccccagtcactggaagtccctgtggctgttgggtgggtaatcgggttggtgcctcaggatacagttccctcccctcctggtgtgtagacagctgggtgtagtcattaaagtggggccactctcagaataaatgtgcagattggctggatctcagtttcagggagaggacaggaggaagccacagagactgaattgttaactccctgacattttcctcctttgtcagtacaatttaacttccatgaggacagtgatttttttccttcttgtctagccccacaacctgtaaaaatgacatacattgattatcaataaacatttgtaaaatgcatgaattgtctcataaagtgatatttattgaatatcttacctgttgaatgtactatgctaaggcctagagatacaatccttaataagacataattcctgccctcaggtctttcttttttgcagtggagtcactctgtttttggaatgtcttattataccttcataaactttactaaaaatgggagtgccagagtagtccagcaataaagaattaattgatgtagccaggtggtgaattcacttttccagaaaggataggctacttggagaccctgcactacttattgatttactcaaagctacaaatgaaaataagatggacactgttatccctgacaggtctaaagctctgagtccaatcaaccatccaccttcacgttttctaccatgtccacctgcagccactgctccccaatctctaagcttagaaggacaaacacccattaaaatgagtaaagaagtgacaagtttaagaatcttgttgtagaaaaaatatgaatttagactctgaaaaagagatagtaaaaactcctcttgaacctcatgctgaatgtcctaagtgtataaaaaagtaaaatgtctaaggctgaacctgttacatttcgtgttctataccacagttccaccccatttgttcctgttttgttgttacccccatgtttagggctcgcatgtccagaaatcccttctcatccaccatgtccatttgattataactattaatattttatcaccatttatttacctctgtcctgccttgattatttcttgatgaaatgtgtaagcctccctttagggtcagtgaaattaggactaggctctggcttgattcttcctggcttcgaatactgtctttgccacttagtgtgtgacgtgaaatttcaccaaggagatacatctacaggacagattgttagaggcacttgtggtttacagatctgcaaatactgtagaagaaaaactaaggggatctcttccatcatcaggaagaaagggttcatttaacagaagaagctcggccaggtgcggtggctcacgcctgtaatcccaacactttctgaggacaaggcgggtggatcacaaggtaaagagatggagaccatctgggccaacacggtgaaaccctctctcttatactaaaaatacaaaaattgtggtttccaggttcatccatgtccctacaaaggatatgaactcatccttttttatggctgcgtgggaattgaacaatgagaacacctggacacagggcggggaacatcacacaccagggtctgtcgtggggtgggaggagcggggagggatagcattaggagaaatacctaatttaaatgatgagttgatgggtgcagcaaaccaacatggcacatgtatacatgtgtaacaaacctgcacgttgtgcacatgtaccctagaacttaaagtattaaaaaaaatacaaaaattagctgggcgtggtggtacatgcctatagtcccagctactcaggaggctgaggcaggagaatcgcttgaacctgggaggtgcaggttacagtgagcagagatggtgccacagcactccagcctggtgacagagcgagactccgtcaaagaaaaaacaaacaaacaaacaaaaatacacaaacaaacaaaaagcaggagaagctcatattctatatccttgaagacaacttgatgataaacagctggagaagtcttacatgcagcaaggacaagggaaaccctcaacagtgggcagaacaggtcaggaagaaaaagaatgttaatgttagcaatgactcttggtacagatgtttctttatttctactttactgctttctctcctaaagtataaactgcaacattgactcctctttcattcacattctcacataggacacaattctggacttgctgaccagtgagaacttattaaagaaaagggctctttccttccagaaggcttgggctcctcctccaattatttacaattattcatgagccttctccgtcccttgtcaaagtccaagattagcagttgattgtacactagagcctgaagagcaaacacgctgagctattaaaggacttggacagattcctatgcatctccaacagtggtaatggaagtgagaattcactctactgcaatacttcccttcaaacgcctcccctcctccatatttgataacaaaaatagtaag

SEQ ID NO: 10764 - DNA, 23116 bp, Homo sapiens
aagatcatgccttaaaccattctcaatgattccctctcggaggcccatcactaaaatgtatttgcacaaggtacttaatttttaaccagtgacagtgacagataagattcaaaccaggtttcctctccacctacctcggaggcaggccacacctgccagaagtagcagcaatgtcccagcatagtgagaaaacggcaccactttggacaaactcaagtaacctgggaagggagagggacaatgtgagaccctctccgcaatgtccctcagctcctcttcccagttcagccccaacctccaccccacactccctgtttggaacagccataccctaagaggaagaagatgcctgatggaagagggaagccaagccatcttcacaggtcccctctcctctttagggagctggctcatctgccaacaacctgcccatttgctaccccaccacctttgaaaccacactgacctttcctgtacaagtagaagaaggcgaagggagaggagtaataagagatggaccagaatactgaagcctgcagcagagagacagggacaggcaatcaatacacacacacacacacacctgccattccaggcatatactatacactctgagcaagatggacaacctgagggatatcatatcatatttggtgtatgacaccatgaatacagtaggtgctcagtatttgttgaaaagtagtgtgtcaatgtaatggaggctgggaaaatttggtacaggctctattttcttcctctggaattatggaagaattatgtcttccatctccagacataattccatcacatttaaaggcagtctctctgtctactcaagttaatcaagccttttcaattggccctgctcaggacagcccctggcctggtccccaagagatgcgcaaacgtcaccacaggaactgtgccagaaagaacagctgtccctgcagccaaagaggttagttgccagggaggacaggtcactggggaactgcaggacttagcacctgcagatggtcccaagagtaaacatgttttccttacggctcaggttgcccccagagaaagcagtgctacataccaaaggggagtgccaagtatgcacatttagagtgtgcctgtgtgtctgtgttggagaggtctgctgcagagcccagggcatcccccaaccccagggcactgttgctcccaagttagggagggctaagttcaagaggacaggtgggtctgaaagatgcagagtcccagatgccagggtagacataccagtgccaggatgctgtcagcatgtttctccagggcacggggctgatagtacgtatcctgccaaaacagatggcctccttaaggaccctgcccactggcaggtcctttcccttccctttcagaagccctgctgtgtgtcctctggttctagtctcgttgactatctctcttgaaacatccctggcccccacagaaactcctcttcctcaccctcactctgaacctaatttcccacccctgaccatgggaacaaacacagggagctggatttggaagcaaaagtgaaagcagcattggacgatttttgctccttttccacagcctagtttcaaatggattgcaggcgcgtgcatgtggggagaagggttagtttgagaagaaagaaaagacacctagacaatctaagaaggaaagaaaagcatcagaaataagagtagttgactaagaagagaatgtgggtaggagcgggcagtttgtaggagacagtaacacaatgagacaactgataaaaaggaagagaatatttagaacagcctaccaccacccgccagctctccagaatacaatgactcgggtctccaggctaggttgggcgggggttgaggggaggaccgacggatacaggatctgtaaaagtcattctgaaattcaaggcgagggtaaagggaagataaaaacagagccgggggaggcatgaagaggcactgaagaagaggaaactgggagtctgacagcaaaattcaacggctccccagtccgcgcagggtctcttcccgggactcaagactcaactgggaccggcacgaaccacgacacacagggtcggggggacgcggagaggaaagaacaaagagtggcagtcggaatgagaaagcggtaaagagcgaaaaagaaaggaggcggccagtccgtaggcgtgactttaactcaggaagcacacagagcgcagattttgcggataactggcttgacaagcaggctccccttatttcccattatgggcacttctggggagcaaaaggccgtaaagggtttggactgtaccacgttcttcggtggggaggaactcgactcacccaggagctggaatggggggcagtgactgccgttggcgtctcagggacgctggccggggccctttcagagtccctctcccggtagattttgtagagccgggggcctaggacgcagctcagcagcttcgccatggccccggctcgggccgctgctcttccagcagcaggtccccctgccggccccgccctccctgcctctgaggtgttgtgtgcccttgacgtcagcccgtaccggctccgcctccgggcgagttgcgacattttcagtgcttcctgagaagagtttcgcgcagttggagctacgggtacagcagtggtccgaaactagtggaagaccactagaacgcggagaatcagaaaattaccgggcatggttcaataatttttttctgtctcattattggcagactctagagcgacagcggaaacgaggggtgagattaggagtacttgataagagtaaccgaaaacataaggtgtctaggaatgtatctagtacaagaaatgcaaggttttatgaagaaaactataaaaagttattgaaaaggcaaactggcccggcccggcgcagtggctcacgcctgtagtcctagcactttgggaggccgaggcggggggatcacttgaggccaggagttcgagaccagcctggccaacatggtgaaaccccatctctactaaaaatacaaaaattagcctggcatgggtggtgcgcgcctgtaatcccagctactcgggaggccgagacgcgagaatcgcttgaacgcgggaggcagaggttgcagtgagccgagatcttcccactgcacttcagccttggtgacagagcaagactctgtctctaaataaataaataaaggtaaactggcccagcgcggtggctcacgcctgtaattccaacactttgggtggccgagggatgattgcttgcgtccaggagttccaggccatggctcatgcctgtaattccaacacttggggtggctgagagaggattgcttgcgccctggagttccaagccagcccaggcaacatagtgagaccccatctctacacaaaataccaagggggaaaaaaaaaagacctagcagggtgtggtggtgcccacctgtagtcccagctacttgggaggccaaggtgggagggtcgcttgagcccgggagtttgagatcgctccatgcactccagcctgggtgacagagccagaccctgcctcaaaataataacaataataattgaaaaaataaaaaaagaaagaggtaaacgaaaagcttttcaataaatggaaagctacaccatggtcctggatacgaaaattcagcacagtaagatatgcggaatatttgtaaaaagaaaataaatgaatcattactgttatgcatgaactggatcttaaaaccatgatgctgagtgaaaatagaaagccacagaagaatgtatacgtgatactagtatattagattcaaaaacacataaaatttaatgataaagcaagtggagaagaaagagaaaattcagaattgtggttacacagcatagaggatctctgactgaaacggaatattctttttttctgtttttttttttttttttttttgagacagggtctagctctttcacccaggctggagcacagtggcacaatcacggctcactgccctgatcctccacctgctgggctcaaccatctttctgcctcaacctcctgagtagctgggactataggcccacaccaccatactcggctaattttacaaggtctcaccatgttgcccaggctggtctcgaactcctgggctcaagtgaacctcctgctttggcctcacagagtgctgggattacaggcatgagccactgtgcctggcctggaatattctatttctttttcttttttttttttcgagaccgagtttcgctcttattgcccaggctggagtgcaatggcccgatctcggctcaccacaacctctgcctctggggttcaagcgattctcctgcctcagcctcccaagtagctgagattacaggcatgtaccaccatgccctgctaatttttttatttttagtagagatggggtttctccatgttggtcaggctggtcttgaactcctgacctcaggtgatccgcctgtctcatcctcccaaagtggtgggattacaggcatgagcaaccgagtccggcctggaatattctatttatttatttatttatttattatttatttatttttttgagacggagtctcgctctgtcaccaggctggagtatagtggcatgatctctgctcaccgcagcctctgcctcctgagttcaagcgattctcctgcctcagcctcctgagtagctgggactacaggcatccaccaccacactcagctaatttttgtatttttagtagagacagggtttcaccatgttggccaggatagtctcgatctcttgacctcgtgatccgcctgcctcagcctcccaaagtgctgggattacaggcgtgagccacggcgtctggcctttattttcagagttggggtcttgctctgttgcccaacctcaaacttctggcttcaatcaaccctcccaccttggcctccaaaagtgttaggattgtagacatgagccaccatgcctggccaggcttcttttactctcattatattgtgagattcaactttgttgcaaatcactaggtttgttcattctcattgctgtccagtcttctactctgttaagcatttatccattatatagttgtacttcatatagtttttggtatgtatggaatatttcatcaaaataattttaaaaataaataaattacacattaaaactgtaataactgcatgaagatctgccttaggagtttttgccgttcagaaggatgaatcagcccgttagccttgtccctgagtaataatttaatacacttattagggtttcaggagaggtccggggtatgccagacaaccacagggaaagtcattccaaatcatttacgggacactgactcgatacacagtcttgtgctgggttctgtggaggaccaacataaaaactcaaactcagtttcttcactcatagctgacatttcttttcttttcttttctttttcttttttttttttttttttttttttgagatgaagtctcgctctgtctcccaggctggagtgcagtagcacgatctcggctcactgcaacctccacctcccgggttcaagcgattctggtgcctctcagcttcctaagtagctgggattacaggcacatgtcaccacgcctggctaatttttgtattttttgtagagacagggtttcgccatgttggccacgctggtctcgaactcctgacctcaagtgatccacccaactcatggctgacctttcttaggagtgaaagagacctcagaatgtacttccagactgacaagagctagacaggcaggaccacttctctgcatggttttttgcatggaaagtctttatttgagccccttagctgatgtggaatcagaagagcaaaaaggtcatcttcagagtggcctgggctgggtccttttctctccaggatagaaaagtggtggtcactttatccctagtagacatgctgctgggctttatcgccccagcattcccatcccctccagagccccttgtcactccagaccagcgagtgtgggcctttatctggactctgcttcctccctggggacaccaggtcttggagcaagagaacttggcaggctctccccatggcagtcttattcctcctcctgttcctatgtggaactccccaggctgcaggtaaggggcaagaggtacgggattccttagctatttgcaaggttggggagggactactgctctttctcctaggagcctggcgaaggcatctgactcaagaagatagaattaccccaaccaacctcctcctgcctctgacactagggaagacccagaggcaacgagggtccaggttatgcagtttcctttataaaataagaagaatgagtaaatgcttccagaaaagtagaaatgagtagaagagatgtgggcatttgccaactttcagccttttccctcttgccctcagaccccctcactggctgggggagagaggaggaaagcccttaccctcttctctccacctgtcttatttttgtagctgtcacttgagaaatgtggtcaccagccaggcctgtgctgggggaccccagaagggaaggaagccagggttgaagatcaaatggggggttattgatctgatggaggtctctggcctcatacaaccctcttcccacagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttgsagggatccaaagaggaagatgccgggcggtactggtgcrctgtgctaggtcagcaccacaactaccagaactggagggtgtacgacgtcttggtgctcaaaggtgagtgggggcatgcagaccaggggctactgtggcccaggaagtccaggtgaagaactgaggaatccctctctcccctacaggatcccagttatctgcaagggctgcagatggatccccctgcaatgtcctcctgtgctctgtggtccccagcagacgcatggactctgtgacctggcaggaagggaagggtcccgtgargggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcaggtaaactgaggaaggagacggaaagggatgttctttcacttcagcctcccaagtagctggaattacaggcgccygccaccatgcctggataattttttgtacttttagtagagacgagatttcaccattttggccaggctggtatcaacctcctgacttctagtgatctgcctgcctcagtctcccaaagtgctgggattataggcatgagccaccgcacctttaaattttttgtagagacaggatcttgctatgttgcccagtctggtctcaaactactggcctcaaatgatcctcctatcttggtctcccaaagtgctggggttacaggcatgagccatcacatctggctattttttcttgaaagaaagggtgaattactataaagggtgtgaggggaaagtgtggttatggctggtggtctgctctgtagttggttgcccatgcgtgagcagggggcattgccattctctactttttattttattttattttattttattattattaggccaggcatggtagctcaatcctgtaatcccagcactttgggaggccgaagcaggcggatcacttgaggttgggagttcaagaccagcctgactaacatggagaaattctgtctctactaaaaatacaaaattagccgggtatggtggcacatgcctctaaccccagctactcgggaggctgaggcaggagaatcacttgaacctgggaggtggagggygcagtgagccaagatcacgccattgcactccagcctgggcaacaagagcgaagctctatctcaaaaaaaaaattgtatttttagtagagacggggtttcaccatgttggccaggatggccttgatctcttgacctcatgatctgcctgcctcagtctcccaaagtgttaggattataggtgtgagccaccacgcctggccttttttttttttttttttttttttttgggatggagacttgttctgttggccaggctggaatgcagtggcacgatcttggctcactgcaacctctgcctcttgggttcaagctattctcccatctcagcctcctgagtagctggactacaggtgcctgccaccacgcctggctaacttttgtgtgtgtgtgtgtgtktttttttgttttttttttgagacagagtctctctctgtcgccaggctggagtgcagtggcgcaatcccggctcactgcaacctctgactccctggttcaagtgattctcctgcctcagcctctcgagtagctaggattacaggcatatgccaccacgtccagctaatttttgtatttttagtggagccggggtttcaccatgttggccaggatagtctcaatctcctgacctcgtgatctgcccgccttggtctcccaaagtgctgggattacaggtgtgagccacagcgcccggcctcttttttgtgtttttagtagagatggggtttcaccatgttggtcaggctggtctcgacctcctgacctcaggtgatccacccacctcggcctcccaaagtgctgggattacaggtgtgaaccactgcgcctggcctcaatttttatactttcagtagagatgaggtttcatcatgttgaccaggctggtcttgaactcctgacctcaagtggtctgctcgccttggcctcctaatgtgctggaattacaggcatgagccactgtgcctggccgccattctctatgggtcagggtgagaggcctggaaaggggcagagtagggtggaggatattgtgggcagggaagcttacaaagtcttctgttggaagagcccaccagactgtggaggggaagcctctctttggggcacagggacagggcccctcactacctccctcccatccctctggtctggcccttactacagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccagrcagaggtgagtccctccctccccggggaaagaagagggcacatgggtgggaggcaaagggctaggctcacacccygcctctgtaccccacctcctctaggggagggggcgaggaacacggctctaagttgtctgctgacttctcttctgtatccctgatggctccttctccccagatgcctcgattcctcagttcaaacccgaaatccaggtctatgagaacatccatttggcccgtcttgggtgaggaacagctagggaacagaggcttaaatcctggaggggactggggatggagaggaaacacgggttgggttggggatgggccctcgttcctgaggatgtgaaaagtagaggtatccttaatctgtctctctggaaaaccccacagcccacctgcccacaagcccaggtgattttggtgacatctgctgggaagtgtgacctgctgtctcgctggccatctggcacctggaagattcctcgacaaccttagcaaggggggcgggactgagagttcgacttcaccatccagctggcctccagcagccaccaagctgtgtatggggaggggtgggggactgaaggaaaggaggagcattattctgtgatgtaacctacaaaaaggtttggtctcctgtcttgtagcagcagtggagggatggccctgagcccatagtactgtggggttgaggggagcctgaggttgctggtgggggcaaggaggatgggtgtgcacagggaggagacaggaatctggagacttgagcaatggtgrggaatccattgcagtggagctgaaggacaaatggggaaaacgggggaagagagagaagggaagagactcaagtcagagaaagtggaaagagatggacagagggagaaaaatagaagcacaaagtgggaggatggagggacagagaaaatggaaagcctcaacccatctctaaattaagccagacccccactaccccatgtctcatcctcacaaagaagagagggaacaggcatatttaatcaaccccagacttcctcacatgcaaggggagggaactgagtcaggatagagatgcctgtgctcagctcccacccggggccccctccttatccttccttatcctaggcacacactcttccctgtggcgccttaccggggcattcagagcatgtgagcagctatcgccactctggcacttccttcctgctgccctgaggtcacaccctatttctcgggggcagagggagtgtctactcaggctggcaggcccagtgggggtatgttatttattgggccggggccatgctgggatgtctgtgaaccatgggcgagtctgggctggtgaagcgagggaggatattgatgctcccaacttggccattccctagtctcaggcagaaatgagctgagctccagccacaccctcacaagcagctccactgggtgcccttttgtgtctctgctcaagcttgggccttactggaaaaaagctttctcagaagtctcacctaaaggcttcaggctgcaggggcttaaactaagccattggcaagaaaaaggacgaaaatgacacagatggagaatgaggggagtgccgtggtccaggttccagctccagcccaacccaccaagcagctacagtttgctcttagagcacacacacacagacacacacacacacacacacacacacacacacacacacacacacacactgcagtatctgcagtattactggactcctagatagaccttttattaaaggtactcttcatagtcccccaagccctccatcctgagttcccgacctaccacattagtctttcctagcaagactctcctccttaccatacctgatgctcctttgatccccttgcctgagatccacagtgtcatcaaaatgcctgccttgccagtgacctgggctgacacggggcatcagcaatgggcatctagaaaagacaaaagacgcagaataggtgttctttatgaggttggactctgggcaggtgcctccccaggccttgtgaggggtctgtgaggggtctgctgagagatctggggtctctgtacaaaattaggttctcgggcatgtctcaaagtgtctgtgcaggtgtttccagggccgcagtgatggcggggggtatcctgggttgggggctgcagatccacggaagctagtggaggaggtgtcctctcccagcgaagctggccacaaagaggggcagggaggcgaggaggctggtgagctgctgtggggaagcggctatgttgcacaggtcctgctcgcagcagtggtgccacagagtgtaggagtgcagccagtaggtggcatagcctggcagagggcactgggcccttgagaggcagctttttcactcagtgatctcactctggtctgtgggatgaaagaggcatgctgaggcgggggccacaggaaaggcyggatggatggaggtagggagcctcctggagaagggccattggaccagagtcctacctgaagtgccaatactgatgccacaagyttcatcgtcccgacactcggtgggaacagggtggcagggtttggtgaagccacagatgtagcagcggagccytccccgggcaggggacatggtgagacctgttgaggcagcagagattaggagagcaggagaggcaaaccctccctgtggggcaggcagaggccagatccggagagggatcacagagagaggtgacacatgaagcagagagaggaaagctgtggaataagggaggaaagctgacagaagtagaaaaaatagctgggcgcagtggctcacgcctgtaatcccagcacgttgggaggccgaggcgggctgatcatgaggtcagaagattgagaccatcctggctaacacagtgaaaccccgtctctactaaaaatacaaaaaattagccgggcatggtggcacatgcctctagtcccagctacttgggaggctgaggcaggagaatctcttgaatctgggtggctgaggttgcagtgagccgagatcatgccactgcactccagcctgggtgacagaacgagactctgtctcaaaaaaaaagagggagacgatgcaggaaaagaaacagagatggaggcaagaggggtacagggattgagagatgcgcagacatgaacagaagccacaagaatcagagaccaacataaaaagagtgagacaaaaagccagacccagcagcaggraagttgagggggtcagtgaaaaagttaagtaaatggcaccagagacagataggaaaatagaaattgacattgaccaaagggcccagcacagaagcaacacgtgaaataagggataggggagacaggggcggatcaaagatgcagcaagggggagacagttattctcaaatgccttgaaaggaaactcttcctttcccacctcatcaggctggccttcccagtggctggtctccctgaagtcccccactcccccagctctcttcttggcctcttccagcacccacacccctctcctccccagccctcaggttcctccacatgcccttgtccccacccccagccccctgaccactgaaggttccccagcccacccttacccagtgccccacagaggaacagcacgcagaggaagatgctggaggtgcccatggccagacacaggctcaggaatctgggagaggtgatctgcaccccgagatcccgggatttgtagagttggagcatttgagcaagacagtgaggaaccagtaaacaaacacacctagggagtgaatctggggggcggaaccatgaccagattcaccagcctgacccagcaggcagcgggggcccccagcctgcccctgcaaggagtctgcccttgcctggagggtctcctctgctctctcagcatgttgtctctgtaacttagcttcctctcctgctcctgagttgtgtctgtcgccttccctcctactcctccccctccctccccatgtctcaagctgctccctggctctctcagcttctctctgtctttgttttctctgtctttccccctcagtgctttcatgtctstcaaagtcaccctcctaaacagccccggcgtrgatctgtttgagtgtagaatcaacaatacccccacccacacacccacatgcacacacaaagcccagctgtgtaagggcggaccccacccagcttcagatccctttgatccccccaagcttcaacattcctaccctgtaattatccctgccagctttactaccttggaggaaagaaataaccacgggtggggctggagggcctgctgatgtgcttgcactggggagaaatcactagaaaggaaggcatggatgggatttggggtaggggggtggtgatacagcctggaaggctggggttgaagagactgggaaggaggaaggcccatctggggaatcagagccagcatgtaccaggaggagtaagactaggaacagggagtgaagataggggagacacaggtgcccaggagagcagctcttttcaaaaatattgatctcaggacctctttacacttttcaaagttacttaagactctgaagagcttttctttatgaggttatatcaatatttactacattaaaaattaaaacagaaaatttaaagtaggtatttattgatttatttaaacaataaaaataataaagtattacatgctaacaaaatacagttttgtgaaaaataactattatttctccacagcacagtgagaagctgagcattgctttacatttttgtgaatctagtgtcaggcttcgtgggagatgcctgggttttcctatctgcttctgcattcagtctgttgggatatgttgttttcgttgaagtccagtatatgaagaaaatctgaccttacacagatagttgcaaaaggaggaccctcaaggaccctgtgaaagggtatcagggatcctcaggggttcttgttggtccacagactgctgctgaggataaaggagtttgaggactccagaggatgctgagagcatgctgtggggcccctccctgtccccactggggcccttggtgcctgctgggggagactctttcttccttttttatagccctataaagctcaaggcacgggggatataaggcaggcagagccgggctggggaggggggtgggcaggaggtagaggcggtcctgacacgggcagactgcgatgaaaccccagtttgttgggatcktgctcagctccctgctaggggctgccttgggtaaggaggcggccagctagcttctcacacaggccttctgccagccggctccaccgagggcccaggtccagcgcctcttttctcctgccaggaaaccgaatgcggtgctacaactgtggtggaagccccagcagttcttgcaaagaggccgtgaccacctgtggcgagggcagaccccagccaggcctggaacagatcaagctacctggaaaccgtgagtcctcagtttctccctcttccagcagcctttccctgyctccagccccatgtcaatccttctggcttccagaaccctccaggctcagtctggctctgggcagatggtgcagctgttagaggagagcagtctgtaccccttctggctcctggcacggagcccctgagaggcccacagtccttgtgcccccacttccccacctccttattctcctaaaagaatctcataggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaatactcaacttctcctaatgctaacatcttacataaccatagcacaattatcaaaatcacaaaataactgatacaatactactaactaatctacagactttatttgatttagcaagatcctacattgcatttagctctcatgtcttcttagtctcctctgatctgtgccagttctgtttttctttgtctttcatgaccctgacacatttgaagagccctgataaattattttatacctggagtttaaaaaattacttttagggccagtgcagtcactcgcacctgtaatcccagcactttaggaggccaaggtgggaggaccacttgagcccaagagttgagaccagcctgggcaacatagggagaccctgtctctacaaaaaacaaacaaacaaacaaacaaacagattaaaaaattagttgggtgtggtggcacatgcttgtagtcctagctactcagggggctgaagagggaggatcgcttgagcctgggagattgaagctacaatgagccatgatcacgccactacactccagcctggggaacaaaatgagaccctgtctcaaaaataataataataataatttttaggctaggcttggtggcacacacttgtaatcccagcactttgggaggccaaggctgaagagtcacctgaggtcaggagtttgacaccagcctgggcagcaaagtgagacccccatctctacaaaaaatgtttttaaaaaattagccaggcatagtggcacacacctgtaatctcagtttcctgagaggctgaggcaggaggattacttgagcccaggagtttgaggctatagggaggtatgattgcaccaccacactccagcctgagtgagagagcaagatcttttctctaaaattaaataaaatcatttttagattaaacaaaaattacgtgccggatgcagtggctcacgcctgtaatcccagcactttgggargccaaggcgggtggataacctgaggtcgggagttcaagaccagcctgatcaatgtggagaaatctcgtctctactaaaaatacaaaattagccgggtgtagtggtgcccgcctgtaataccagctactcgggaacctgaggcaggagaattgcttgaacccaagaggtggaggtcgcggtgagccgagatcacaccattgcactccagctgggcaataagagtgaaactccgtctcaaaaaaaaaaaaaaaattacagatacttgaaatactaaaaattattttatagaatgtccctcgatatttatttatctgatatttgccatgatgagattgaggtcatgcattttaagcaagaatactgcagaagtgatgttgcatccttcttgctgcatcacatcaggagtttacaaggtcaatgcattaactttgatcacttggtttcagggaggtgttttttgagggggctgaaaatccctttgggctccttgaaatcacatctgctctgccccagaaggcaagtcctgaagccaggagtccaacaccccagtttcattctctctctcagccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagasaaacatccttctgtgagtcattaaaatctatgaaccactctacagctgactggaaaattacatctatctttggttgatgggagggctaaaagcgtaatatggggcatccaggttctagtttgggggttaccaagcaacagcgggcttaattacagtggtgcactccttaaccaactaaaccccaaagggcaatggcttatctgccttctgtggctcctggatcctgttgctgggttgaatcttccttagcaatgagattcattgagtggggttgccagggttttgtgagcctgagtctgggtttgctcccctatttcccatttgcaagttggctcccaataggactattttgaattgagaaaagaaatgtaaaaactgtgataggtaaaaactgcttgatgccctacttactaactaggctaggtgaggcctttgactctaacctgagagaaactgaagaaacagggtctcaggccccatctccatgtacctctcctatcctttctggagagccctcaagccaggccgcaccttcttcttggcaatacatcaggggtgtggcctaaatttaggatatgagttgttgtgtgccacctggagacactggaagggaggatgaagacctgaaaaacctgtttctccattttccccagcccagcctcccagggaacctccctgaaggattcctgtgtaagggagggagattgagagtattatttcctgggaggtgacctgacccttaggtcttcttataataaatgtacattttatcagactcagacatttattactcaaaatggaaagaggtgagtatgggggatggggtacatatgggagcctggrtttggggagtcagctctgtacagtgaggtcatcaggtccttgtgggagccttcactggggacaacacagaagccccatttcaggcccagatcccaatccctcctcaagtaggggacagcagagtataggaagcaaagtggggagcccttctaggagccaatggaggtcctggaaggaagtgggaagggacccagaaaaaggagagtgaagggtgtgaggtgggaaggatggatgaggagaccactcggaacagtgtttaattaaagaaatgggagctagggagagacgattctgtaaagccaggggatacagagacacagggagagaggctcaggccaaggcaggtgggaggaggggcagccaatggaatgagtctcagtgcagcagccagaggccaaggccagccaaggaggtaaggaagacaaggcccagggctggagtgggccggggtcctgcgctgttgcagttgtccttgttgcagcaggtggtgttatatgtcagacccagcttrcggttggtttggttgaaggcctcctgacagggctcttctggtgtgccacagcgcagattggagaaaacccacatcttacctaggggtgggaatgggcagggaatcggccaggatgggcacctggcatgcctgtgtccacctccccaccccatccacccacctaggcttccttccttcccaactctgtccctggccctccccttctcttttcttagtctgatcttccttctgcacatccttacccaccactcccccagtcctggttctatcacttgctggccatggacctgttactgtctctgttttttgtttttttgttttttccaagacagagtctcactctcgcccaggctggagtgcagtggtgccatctcagctcactgcaacctccgcctcccaggttcaagcgattctcctgcctcagcctcccgagtagctgggattacaggcgcccactaccatgcctggctaatttttgtatatttagtagaaatggggtttcaccatgttggccaggctggtcttgaactcctgacctcaagtgatccaaccaccttggcctcccaaagtgctgggattacaggcatgagccaccatgcccggctgtgttactgtctctttttgaggccgttttctcagtataataatagcacccacatcacagggttgtcatgaacattaattgaaaaaaaggcatgcaaagacataggatgttgcctggcacacaaccatctttggccaaatattatcattgctataatcctctgcttctccatctcagtcttagacccatttgggcctcagtcctggtcatagaggctcccacctccctgttcaccccactaaggaaggggatgttaccaaggtatgcatgtgttgtcaggcattgctgtcctggctccaggcggcaggactgccggtccacacagcccagcacagggaccttgtagcaggagtgacagcgaatgtcagctgggaagacacaagtcaggctgaggtgatggggtctctgacttacctggggataagctgagctgggggcaggggtggagggtggagaagagcccatcccgtaggtgctccaacctgtttggctgtttggtctagcaagcacagagcaggtgagtgatgcagggaaaatggaaagtgggcggcaggtaagggtagagctgttgctttgtgaaaggcccaygccctacatatcttccatcactccaccccgtttggaggtgagtcaagagggacagaactatgaagaaaaacatggggctggagatagatggaatgtgaggaagataccatggggaaagaatgtggatggtgaaggaggagatggaaacttgaaagaaggagaaataataaaaatgaaaatcatgagggttacaacactgtcagaaatgccttggaacttgaggctggcgagaaagccatctgtggccagctttagcaatttacaatttactcttcacctcctggagctggcaagagtgtggcaagaggaaccagacctgaatagaatcctctcaccccagtagctcttcagcagaaaggaatgatacctgagagacagatcaccagattccatcttagcaccttatcaaaatggagagggtggatacagaaggtggcaccccaagtttcctgcttcagttaattcaaggtttgggcaggcaagatttggtgacgcagggtccgagggtggaagagcctggtaagtgtacctcagtgaaatccacttcaccctggaggtaagtggcccagttgtcccctcttcagaaggctcaagaaaacgctctgtttccatggaggctcttagatgtcactgcaaccatctagaaagtttgtatcccctgtatgggaggaggtatgcaacccaggaggggagtagggggtatctaggaaaggccatggctgagagactgaacatgtgagtccctgatggagtagatggggagggtaggttacaaaaggagcctggggctggatgcctaggtcttcgagaggacaccttactgagcacagcagatagaggagaaggcaggtaagctagactctggagagttgcatattgaagtggggctggttggggaactggataccagagtttccaaggaggagacaccttggagtggggaacaggggacccagagccctggcaggtgagagaaatgggtctttcttggaggtggggaggatggatggagacctggctttttgagaaatagagcaaggaggctgtcatagggaagcctggtcttggtggcacaggagagctgagccagttggggctgggggtgttgggatcccgagtggtgggtagggccgggaagtgggtagagcagggtgtaaaggtcctgaccaggcaaaccaggtctttggggcccccaggtgctcacctgagacccagcagagcagaacagacagggtgagcagcataagggctttcatggcgagggtcctgagaatggtggcaaccacagcagctgatagagtagattttcaaggatccagctctaggagttgagtggcctttttggaatttataaacccaaaggctcctcccttccctgcctctggtagcccctcccttctcacttactacgcagctgaccagagaaaagacaaggggtgggaaggcactgagcaggactgagtggggagtagggatgggagagagggatgggggaaggcaggtgccactagtggccaatgccattgtggttcttggtttcaggccaagatgcccttcctggtccccagctaagagtcctgctgctcagtcctctgaatgagcatcatcaaaggcctctgtgatttacagtgtccatggtggcagcttctgctggttcctggaaaatggacaaaaggatgtggcccaaattaattgctgaatttgggtccctgggtccctgctgggcattgataggggcatgctggtggaaattgggggaggaatgggtcaaattaatctccattcagcccccactcggtctttccaatgcctgctcagcaataagtgactcactgatggcttctgtgatgccacagcagcagaggcaggggctggggctactcatccaggagagccaccacaggtctgctaagtagggctgcctcaggctcccatgaaggttctcaggatgtcacccgtgctccacttgcgcttggtgtggccttgttgctccagtccagcagcagcaattgtcctaggtgtggctgtgtgcacctgctccaaagcacctccccagtcaaaacctgccaacttgggcagggtaccaagccaggaggaacagcatgggcacagagaggtgaggtagaagctaaaataagaatagaaatagtaggccgggtgtggtggctcacacctgtaatctcagcactttgggaggccgaggtgggtggatcacaaggtcaagagatcgagaccatcctggccaacatggtgaaaccccatctctactgaaaatacaaaaattagtcggtgtggtggcatgcacctgtagttccagctactcaggaggctgagacaggagactcacttgaatccaggagccggaggctgcagtgagtcgagattgcactccagcctggccacagagcaagactctgactcaaaaaaaaaaaaaaaaaaaagaatagaaatagtaataataatggcaagcacttacatagtgatcctatgtattctaagcagtttacatgtattactttatttcgttatcacaatcccctacaaaacaggagtttttgttgttgttgtttttgagacagggtctggctggctctgtcgcccaggctggagtgcaatggcctgatcacagttcactgcaacctcgacctcctgagctcaagcgatcctccctcctcagcctcctaagtagctgggattacaggcgcacctgaaaagttaagcaggccaaagcatttgtgtaaatggcccgagcacacattttaagtgagaaccatttgaagactccgagtttgcctgcgaggattcccaaagggatctgggcagctggtggccccgccccctctcttatcggagccccccagcccctccgttctccccacgcctaacttccctccggtccccccccaaccggccccacgccgctgattcgctcgcagcttctcctcaccacatcctaaccatggctgtgtttctgcagctgctaccgctgctgctctcgagggcccaagggaaccctgggggtaagcgatccctgggagagttgtgatagacgcagaggggctgaagcaagataagggccgcctagtagggtgggttgtgtgtgggaagatccaggatggctggagtgcagaacagagaagagaaagaggagacgggatggagggtcgtcttgccctgtggacgtgccctaaccacagcctccggcctctcctagcttctctggacggccgccctggggaccgggtgaatctctcctgcggaggagtctctcatcccatccgctgggtctgggcacccagcttcccggcctgcaagggcctgtccaaaggacgccgaccgatcctgtgggcctcttcgagcgggacccccaccgtgcctcccctccagcctttcgtcggccgcctacgctccctggactctggtatccggcggctggagctcctcttgagcgcgggggactcgggcacttttttctgcaagggccgccacgaggacgagm

SEQ ID NO: 10765 - DNA, 23545 bp, Homo sapiens
atctgcccacctcagcctcccaaagttctgggattacaggtgggaatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgggcaaggggctggtcctgtggggagaggaaaagactggagctgcaccctagctgtccatcttctctcagagaaaaagaaaataagcttcagccaaatagacagagcttggggtggttctcaagggactgtattagacaagtgggggccaggagtggtctcggagctacatccttcagcaaaagaggtgagtgtaggaaggaactccgtggagtccctcatgacctgggcatcctgatgtacacccaggtgctgtgaagatcacccccgcacatgaccaaaatgactatgaagttgggcagcggcacgggctggaggccatcagcatcatggactcccggggggccctcatcartgtgcctycgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggtgagcagagggccagagctagctgctgggacaccctgctggagtggtgggtttactgggtccttggtggggggaggggcagggtgagccagaagcagacacacccccttgggtaatcactgcacctgtggcaggaccctgatgggcggtactgggtgagtggacgcaatgaggcggaggcccgggagaaggcagccaaggagttcggagtgtcccctgacaagatcagtctccagcaaggcaaggcggggctttgagggtctggagggagttgtggggggcagagctccactccctctgacctctgacctttggcctctctcagatgaggatgtattggatacctggttctcctctggcctcttccccttatccattttgggctggcccaaccaggtgtgttcctggggccggggcttggcgggacaggggactggagggtgggtgttggctccccttcacaccctggtctgccctcagtcagaagacctgagtgtgttctaccccgggacactgctggagaccggtcatgacatcctcttcttctgggtggcccggatggtcatgctgggcctgaagctcacgggcaggctgccctttagagaggtgcggagacagccgagaccctcccatcgcccccagcctcctctcctaccgtcctgtgctgcagcgcagacccygcgtggctggggcatggggttagctgtgggcaggcctgacccgggggctggtgtggggttgaaatccagcctgggccctgctcagtgattcctgtgcccagggcttcatcttcccagaggaaggagtgcttctgattcacataaaggcgctcaacgagctcttggggacactcagtgggacctgaggttcacagtggggtagaccagacacagtcctggtcggggcactgaggccggggaaggagaggactgagtctcatgggcctccccacctgctctgcaggtctacctccatgccatcgtgcgagatgctcacggccggaagatgagcaagtctctaggcaatgtcatcgatcccctggaygtcatctatggaatctccctgcaggtgggctgggtgctgggccagccaggaagggccgtggggctgtggtcacagccacctgactgctcccactccaccctcagggcctccacaaccagctgctgaacagcaacctggatcccagcgaggtggagaaggccaaagaagggcaggtatggagggttgggctgggctaagcaggagcacagcgtggatggggctggctgaggacgctcctccccctgcctcttccctgtagaaagctgacttcccagcggggattcctgaatgtggcaccgatgctctccggtttggattatgtgcctacatgtcccagggtatggcccccaaagcgtccctcccagccactccttcctccttctgtgaggcccatccctcttctccaccctgagcctctggtgggcatgggctgggaagagggtgatgaggactcacatctcacccccgacccaggtcgtgacatcaacctggatgtgaaccggatactgggttaccgccacttctgcaacaagctctggaatgccaccaagtttgcccttcgtggccttgggaagggttttgtgccctcacccacctcccaggtaagggcctggtgggcagcaaagctggcagcactcacacaggctgtacccctgtccggagcagcctccatgtagctggggggacagatagacacagagacagacagttaaagggaaagcccagcgcattgggggctggggcctgtcacttcttcccagatcctggcacataggtggttgctttggactcatcagactctggatgaagatttgcccatgactcctgcccccatggggttctggcaccctcccctggcccgccggctgatacaccctctctccccaagcccggaggccatgagagcctggtggaccgctggatccgcagccgcctgacagaggctgtgaggctcagcaatcaaggcttccaggcctacgacttccyggccgtcaccactgcccagtacagcttctggctctatgagctctgtgatgtctacttggtgagaaggagcacagcggggcaggggatggtgggggcaggtggscagcagagccctgggctcagttttgccagagttggccttgagacctaagccaacccatccccttcccagtcctcacaggcacagcgagggctcaaggctagacctccagccgtgagccctgtacctctcgtcccctaggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagaggtatggcatggcctggagaggggagtctgacctgccctccaggccccctcaccccctcctccaccccacagtgctcctggaaggaccccgaggcagaagccgcccttgagctggcgctaagcatcacgcgagccgtgcgctccctgcgggccgactacaacctcacccggatccggcctgactgtgagcctcaggcccccatgtccgccccatcccactgtcccctcagcctactctgggacccagtgtccggcagtgactgcttggtttcctgtctccatggagctaggcctcacctttctccctccctggcaggtttcctggaagtggcggatgaggccacgggcgccctggcatcggcggtgtcgggctaygtgcaggccctggccagcgcaggtgtggtggctgttctggccctgggggctcccgccccccagggttgcgctgtggctctggcttctgatcgctgctccatccacctgcagcttcaggggctgrtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaaggtgtgtggcctgggtgggcatttcccacaccatccccttcctccatcaaaaccctggtctgggctggtccgagtgcagtggtgttgacaactaattgatcgtaaccagttacagatttctttgttccttctccactcccactagccttaaaaaacaaaacagcctggctcagtggctcacacctgtaatcccagaaatttgggaggccaaggtgggtggatcacttgagcccaggggtttgagaccagccaacatggtgaaatcccatctctacaacaaaaatacaaaaattagctggccatagtggcacacacttggggtcccagctactcggggggctgaggtgggcggattgcttgagcctgggaggtcaagactgcagtgagccgagatcatgccactgcacttgagcctgggcaacagagagaagaccctgtctggaaaaaaaacaaaacaaaacaaaaaccaatcctggtctggaagctggactctgtacccaaccctggggaatccactggggagcatggagcccaggcgctttgagcagggaccatagaaggccctccccttacacatggggagcagctgggggctgggcacaacccagggtcacacaacaggtgggagacggaggctgacctagaaccaggcatcctatctcccagccagacccttcgtaccccacccagctgcccaaaatgtggaaacctgcatgcctggggctgggcttggggtccacatgtagtcggggagccctgggcctcccaccacttactttcaagcctactgggctgaccctggaaggccagtcttgtttgtcccctgcctcctgggttccgccagagagaagcagtggagtaaactgcacagacacagagaaaaccagtcatggaggccaagagctagagagccttgagtggacgtggttaatctcacttggttctcccaagagccctgggaggggggcaatatcatcatcatcatctgacaaatgaagtgaccggcctgggagactgtgctctcctgcttaggtggggacactgaatggggaacacgtaggctctgaggttcctttgttcttggggactcaccacttggtggaaaaaggcaagacccaagaggtggtggtggaagtgggggtgctggtgggaatgggtggggagccaggccagccaggttcacgcctcctctgagctactgacctcccatggtcctcgctcatctttccaactttgttgtcctgggtgtttgggggtctcttcacttggacctgggtcctyacccaccccctggttccactccagctccaacagacagaagcagagctcaggaaggtggatgaggccatcgccctattccagaagatgctgtgatccaccacccagcttcacccctcacccccagcggctcaccatggggatggcagcaataaaatattttcccacaaaatcctcttgtcatctgtggtgggggcagagaggggagcagaggggctgggtgcctgaatccttgggggctgcagggtgggagtgaggccctggttctggagggcagaggggtgcgtctatctgggtctgtccctggcactgtgccaggcctgagtcacgctgcttactcccttcctcctccccagctctcactcacctccgcactgcagccaagggaggcccgccctggcgtgggctgctgcctgtggctttgggcaggcaggagcgaaagggccaggggttgcctgtcctcccccaccctgttgaggccttcctccccctctgctgagcctcggttaattataactctgacctaagtgccctgtgacgtcaagcccgggccagccctgcccaggagacccagcaaccaggtaggggagggcctgagaggactcaggcttcctgagcatggggagtgtttctgcggcagggctggggacgcagccagggactggggaggggggcgtgggggaggaaccttggacccctctcctggcaggtgtgtatgtccctaatggtccgatgaggccctcaggtmgtctgggtgacagcgagagggtggggaagccaggctggagcagacacgacttttgaggtaaagcaggttcccatggagacccgcagagccggcctgccctggaatcgcggctgcttcctcctcccttgagagccttctgtctcccaggtccatgtctcagccatgctccccacggaggtcccccaatcccacccgggcccctcagcgttgcttctgctgcagctgttgctgccccccacatctgccttcttccccaacatctggagcctgctggctgcccctggctccatcacccaccaagacctaactgaggaggcagcgctcaacgtcaccctgcagctcttcctggagcagccacccccaggccgcccccctcttcgtcttgaggacttcctggtgagcatcccagggtcctgtcacacccctgccagagtccccaattccatggggcctctactccttgagggctctggttgccaagagaagagacacccatggccccacccctgcagcaataatacccagtagtcttggtcctgaaattaggagtccccctccttagaaaggtccgggactgtccctcctttgtggggctcaggaccctcatacccagccttgagtgtcagttgctgagataaggtgggcaacagtcaatccaaagggcctccctggagccccgtcgcccgctattctccccagggtcgaacactccttgctgatgacctctttgccgcctactttggacctggttcttctcggcggttccgagcagccttaggtgaggtgtctcgtgccaatgcagcccaggacttcctgccaacttccaggaatgacccygacctgcactttgatgctgagcgactgggtcagggacrcgcgcrcctggtaggggctctgcgggagaccgtggtggcagccagggcccttgaccacaccctggctcgccagcgcctcggggctgcacttcatgccctgcaggtgagaacagggttgggttgatggtcagaggggtcttcacttccgtgcctgtccgggatggagcgcgtcctatggtgccttcttgatcatgtctcctccactctggaaggggtgggcactggcacgcggtgccccgaggctgtgtcccagttccccacctccaagctggcagtgcttcctgtaggaacagcaaggagggcgctgtggctggagagaagtgagggtgagagaggaaggctgcgaggtcagagagctgagggagcagcacacgcagcaggactctgcaggccgagagaggccttgggttagactctgagctgggaagagatgctgggacagtttccacctgggcaaagctctgctctgagcaatggagagagggcagtggaggggacttggggtgtctggtgggagcagtaggggtgggaggggactttcgggatggggaactcaaaggagtggcatattagtgctggagatggtgagaaaggccagactagtgcctcactccccttctcctgtcctccggaccaggatttctacagtcatagcaactgggtggagctgggcgagcagcagccacaccctcacctcctctggccaaggcaggagctccagaacctggcacaaggtatggctgtgaccctggtggtgaggcaggagtccacagggccacctcagtccacccagccactgtgtcacattctgaagtcccagagggtatgatgttacttaatctccacaaggactgaggtcccccagtccaagcaacgcctggctcagttaagcagcttccccaaggtcacacagggaaaagtagctaggaccaggtctccagacctcagtcccgtcttaagtgtggcttcctccccgcactgactcccatggggccttctctcacagccccctcaccctctcacctggaagctgcctcctgtccacaactcacagagggcataatccccataggattggtccctacacgtactgtgtttgtttttttcttattatttatttatgtatttattttttagagatgaggtctcactgtgtggcgcaggctgctctgcccgccttagcctcctaaagtgctgggattacagtcgtgagccaccgcacccagcctgtgctgtgttttccagcacagcccyagtttcaaacattcaggctcactgcgggcccatgatcctaggttttagttcagaaagctttgctagggaacttctgggtgttcgcctcatcccagctgggaggagaagctgaaaaggtttgggtgggtggggataaaggctgggggtggcagaatcttgggttctagccctgccctctcttcccagtggccgatcctacctgctccrattgcgaggagttgagctgccccaggaattggctgggcttcacactcctcacctctggctactttggaactcatcccccgaaacctccaggtaccagacaagaaagttccccagaagtaaggggagaaagtcattcccttryaggatctctgtcctgtaggcccgtatgcctttgctatggcatctcctcctaggaggagaggatgctgggaacagggtgggtggaggaaagtcccctgaggaggctgtggtggggttgaggtaggggagcaacttcttcctccgctgataggatttctcccttgtcataggcagytttgggggactggctggagggatcaggggatccaccatgtgctgtggtgactgaccaccacgccctaagatttactccagaattcccctccacaaagcaccatcctttttatcctttttttttttttttttttttgagatggagttttgttctttttgcccaggctggagtacagtggcacgatctcggctcactgcaacctccgcctcccaggttcaagcgattctcctgcctcagcctcccgagtagctgggattacgggcatgtgccaccacgcccggctaattttgtacttttagtagagacagggtttcatcatgttggccaggcttgtctcaaactcctgacttcaggtgatccacccacctcagcctcccaaaatgctgggattactggtgtgagccaccrtgcccagccatcatttatttatttatttattttttgagaccgagtcttgctctgccacccaggctggagtgcagtggcgtgatctcggttcactgcaacctcygcctcttgggatcaagctattttccttcctcagcctcctaagtagctgggattacaagcacgcgcsaccacacctggctaatttttatagttttagtagaaacagagcttcaccatgttggccaggctggtcttgaactcctgatctcagatgatctgccggcctcggcctcccaaagcgctgggattccaggcgtgagccaccgcgccaaccccgtcatcatttcttgctgaacccttgctgaggggtgagagggtcaggccaggcctgaaagggcctcattttcttaggaggcagtgggtttttgacctccactctccagatccctttccccaacccagggaaatgtagccacgggggccattttgaccggagcagctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggtgagtggcctcctggggatggaccccttcatggggaggcgctcctgcgggaagggagaaaccaggcgctggggacaaacgtgcaggcccttcactgtgtctctggcttgctccccaggctgctggacatcaccccagcctccagcctgagctttgtcctggacaccacgggcagcatgggtgaggagatcaacgctgccaaaatccaggctcgccaccttgtggagcagcggagaggcagccccatggagcctgtccactatgtcctggtgccttttcatgacccaggtaagtgtggtctggctaggacagtagaggggaggaaaattcaaggtaagggatagactgggcgtggtggctcacgcctgtaatcccagcactttgggaggctgaggcaggtggatcacctgaggtcgggagtttgagaccagcctgactaatatggagaaaccccgtctctactaaaaatacaaaattagccgggcgtggtggtgggcacctataatcccagctactcsggaggctgaggcaggagaatcgcttgaacccaggaggcagaggttgyggtgagccccgagatcgtgcctttgcactccagcctgggcaacaagagcaaaaagctctgtcacaaaaaaaaaaaaaaaaaaaaaaaaaaaaaagaaaagaaagaaaaaaaaaagaaaagataaaaaggtaagggataaaggcctgtggtgaggaagtgggctcggggtggcacttcctgtagtcccgagtgagcctctactgtgtgcatacagaaaattagcagcaacctgggtggggtggctcacacctgtaatcccagcactttgggaggcagaggtgggtggatcgtttgagcccaggatttcaagaccaacctgggcaacacagagaaacacaggtctctacaaaaaaattaataaaaattatgtgtgggtgtggtggcacatgcctatagtcccagctacttgggaagctgaggcaggaggatcacttgagcccaggagactgaggytgcagtgagccgtgatggcactactgcactccagagcggcctgggtgacgcagtgagaccctgtctctaaaaaaaaaaaaaaagataactagcagacttgcctcccactctttctaaaatggcagcactttccatgagtttaatgcatgattcatgctttggcacgtggcctctgctttcttaggctttcatgctaataaaccattttctttttttttttttttttttttttttgagacggagtctcgctctgtcgcccaggctggagtgccatggcgcgatctcggctcactacaagctccgtctcccgggttcacgccattctcctgtctcagcctcctgagtagctgggactacaggcgcccgccaccacgcccggctaatttttgtatttttagtagagacggagtttcaccgtgttaaccaggatggtctccatctcctgacctcgtgatccgcccgcctcggcctcccaaagtgctgggattacaggtgtgagccaccgtgcccggccgccattttcaattctctccatttcctatagacagagattggtatcaagatggggttgttggggccaggcttctgggaagcatctgagataactagctacattgtattccttttccattgattagaagttagactctctggcttgagtctgactgtgtgtctttaggctggtcatgtaaactttctttgcctcgatttcatcatctgtaaaatgggtatcagttatcacatcagggtggggcaggatgttggaatgtcatcagttaaggctattttcacttcttttgtggatcttcagttgcttcaggccatctggatgtataagtgccagtcacaggggatatgattggttagcttgggctcagaggcctgacacctccctcatcctgcctaactcccagagttgaaatgatgatcaaataaaatgcctactggactgagagttgcctaaatttgagtcttatttgcctgcatacatcctacagtggctggcatttaatagacttattatgtttgatgaagatataaataaaggtataactaagaacttagcacttatgtgtcaaagcactatcttaagatttgcaaaatcaactcatttagtcctcccaataaacctctgaggtaagtgctattcggtctcttttcttatgaggaaacccagtttttttttttcttttctttcttttttttttttttttgagagagagagagggagagtctcactctgtcacccaggttggagtgcaatggtacaatcatgcctcactgcagcctcgattcaagcaatcctcctgccacagcctcctgagtagctgggactacagatgagcaccaccatatctggctaatttttgtatttttttgtagagatggggtctcactatgttacccaggctgatctcgagctcctgggctcaagtgatcctcccacttcagcctctcaaagtgctgggataataggtgtgaccatttttttttttatatacgcacatgtagccaataaaggcctacaggaaatgccaccatttttttcagggagtggaggccaccttcccaccagggacacctaggtctgccctgccctgccccgccctgccccgccctgcactgacaagtatgactttttttttttttttttgagatrgagtctgtckccagactggagtgcagcggcacgatctcggctcactgcaacctctgcctcccgggttcaagtgattctcctgcctcagcctccccagtagctggggaggctactggggagcctctggggaggctactggggaggctacgggcatgcatcaccatgcccagctaatttttatattttttagtagagacgaggtttcaccatgttggccaggatggttttgatctcttgacctcatgatccacccaccttggcctcccaaaatgctgggattacaggtgtgagccaccgcacccggccaagtatgagtcttataatggagtattgttatttcaatacctgtcggctccagaagcacaccaggcccctcaactggggaggtggctctgggtaagaatgaggggagctctttcctcacttatcttaacctcctttccccttcccagggttcggccctgtctttacaaccagtgaccctgacagcttctggcaacagcttaatgagatccatgccttggggggtggagacgagcctgagatgtgcctgtcagccctgcaggtctggcccctcccttcttccccgtttcctggccccaccaccagggggagctagatccctcctggggctccccaccwccttcagcacctagatccactagcttcactgtagggttcccgggccatattcccttctgcttcatcctccgtggctctacccattcccctcctactgccattgttaacactggtcgttgccttccctgccagctggccctgctgcacacacctccactctcagatatctttgtcttcacggatgcctcccccaaggatgcctttctcaccaaccaggtggaatccctgactcaggagcggcgctgccgggtgagcagagctagtgggagacccagtgttagcctyccagggatgtgagagaccctgtgatgacaatctcataacgagggttgcaccacactatggtggcccaacaagccttggtatatggtgggagaagcagacaatgagtggaacatttcctgatacctttaatgatatacgtaagaggccctacccttaataacgctgaatttttatttgaccctgcctaataaacaatgtgaagaactggggctctagtcgccaaaaatccactgtgacagttacaagggggtggccaactactaactgaaggcagggggttctgtcattgggattccccaccccagcagccagaaggcaggcagagaccttatcacaaaccatcagctctggagaaagcttgagcacagggattctcattcataatagtggatggcacttggacaccccaatcactgagctctcttctgggtacaggtaacattcctggtgactgaagatacatcaagggttcagggtcgagctcggcgtgagatcttgtcccctctgcgttttgagccatacaaagcagtggccctggcctcaggaggagaggtgatcttcaccaaagaccagcacattcragacgtggcagccattgttggggagagcatggctgccctggtaagtgggggccagggccctcacttaggaactgaagggtggtcaggctgcacctctcttcttataggagaaaggggaatcactctcactgctgtgttgttcttccagtcacggggcaggaaaggaagtttctcttcctcttagatccatgactagccacttctttttttttttttgagatggagtcttatggtcacccaggttggagtgcagtggcacaatctyggctcattgcaacctccacctcccgggttcaagggattctcctgcctcagcctcccaagtcgctagagttaccagtgcccaccaccaggcctggctaatttttgtatttttttagtagagccggggtttcaccgtttttttggccaggctggtttcgtactcctgaccgcaagtgatccgcctaccttggcctcccacagtgctgggattacaggcgcgagccaccacgcctggcctgcattgtccttttatatcagtaaacctctccccacttggcttccagtattctgcctccagggttaccacaggaagtcctaccatctttttggggaggtggcttgtattttgcagagacagagtcttgctatattgactaagctgttcttgaacccctggcctcaagtgatcctcctgccttggtctcccaggtgctgggattacagacatgagccaccacgcctggcctatcatcttttaatggggcacaagatgtgattgtctcatcctgaatcccttgcctccaactttgtctctgaccataataacttcatccctggccccgtgcccctctcttactggtatccctttctgcctgtttgacgtggtttctttcttttttctttttctttcttttttttttttttttttttttgagacagagtcttgcactgtcgcccaggctggagtgcaatggtacaatcttggctcactgcagcctctgcctgttgggttcaagcgattctcctgctccagcctcccaagtagctgggattacaggagcccaccaccacacctggctaattttttgtatttttttttttttagtagagatgtagtttcactgtgttggccaggctggtctcgaactcttgaccttgtgatccacccgcctcagcctcccaaagtgctgggattacaggcgtgaccaactgcgcccrgcccaatgacgtggtttctttctatctcccctttcttctttgttcctcatcccatacctcatcttcttccccattttctggtcctgccaatccctcaaggtgactcttcccctggaccctcctgttgtggtgcctgggcagccacttgtgttcagcgtggatgggctgctccagaagatcacagtccggatccacggagacatcagcagcttctggatcaagaaccctgcaggtacctctgaaggtagagggaagagaggggaccggggaatagacaatcgaggggatgtactcaaggagagcaagtgcttcatgtgacaatctcttccctgaccccaggggtctcccagggccaggaggaaggcgggggtcctctaggtcacactcgccgctttgggcagttctggatggtgaccatggatgaccctccacagacaggaacctgggagatccaggtcacagctgaggacacccctggggtgagagtgcaaggtaaggagggaggtgttcctgggaaggggaagcagagactgcaggcctcagagaacacgatcagtcacattcctttcaggaagggctctgactgcctttgccctttcccagcccagacctccctggacttcctcttccactttgggatccccatggaggatggaccccaccctggcctctaccccctgactcagccagttgcaggtacatttattccctgagcccccacccacctaacccccagttttwtatatatatataaaatatataatatataatatatatattatatatataatgtatatatgtatacatacatctgtgcatatgcataacttttatattgagttataatttacataatgtgcactaaagtgtacagtttgatggatttcatataatacacccagttcaggatatagaacatttccagcaccccagaactccctcctgatgctccccatcaatacccctcgaaggtaacctattttcccatccatactccccagagggaacccctattttgaaggccattaattcttttctccctgtgtctccgaatctcacaatgttctcccctcctcgcccctgtcccaggtcttcagacccagctgctggtagaagtgacagggttgggttccagagccaatcctggggatcctcagccgcatttctcccacgtcatccttcgaggggtcccagagggtgccgaactaggccaggtgcccttggagcccgtgggacctccggagcgaggtctcctcgcagcctcgctgtcgcccacgctgctgtcmacccctagacccttctccctggagctgattgkccaggacgcagcggggcggygcctgcacagggctgcccctcagcctagcactgtagtccctgtccttctggaggtgagacgccaggggaaagtgcggctggggctggagagagttagagcggccccttccctgaagaacccttctctgcagcttagtggcccctcgggtttcttggccccgggcagcaaagtcccrctcagtctccgcatcgccagcttctcgggccctcaggatcttgaccttaggactttcgtcaaccccagcttctccctcacctccaacctctccaggtgaggctcatgaaccctccagctccctctggcatcttgcccggccaatgcttatcccaagccctgcccctgtccccctccgactggccctcagaatcctcctctccgctcccgtgcccctgcaggcgtcccgactctaggctctgggcagcctggagctttagcgacgcctatatcctctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcaggtgaggaacyactactttccatcacagggtgggcaaggccggggagggtggtgtaggtttaatttgagtacagctctagcacaccctgtcattctcttccttttccccacaggaccggcacaccacccctaccggctcatctgacccgatcctcaccacggccacccctgccttttcccccttcacattggtgrctcaaggcagggctggggcagggctggctgcgggcagcccctggtggggcacagttggaggggtgctgcttctgctaggcctggcctcctggtgacacaacgggctctaaagggatgggtctccagcactattttcaacctgccccattggtaagaagacctgggacacatttgtcacataggtcttaggaccttacctctcctagctgggatgaaggttttctcttttttgttgttgttgttttttttttgagatgtagttttgctcattgcccaggctggagtgcagcggcgcaatctcggctcgctgcaacctctgcctcctaggttcaagcgattctcctgcctcagcctcccaagtagctgggatcacaggtgcccgccaccacgcccggctaattttttgtatttttagtagagacagggtttcactatgttggccaggctggtctcaaactcctgacctcaggtgatctgcctgcctcggcctcccaaagtgctgggattacaggcgtgagccaccgtgcccagccaatgaaggttttctttctccatcacatccctttcctttcttagaaacttcgagactggggctgggtgcagtggctcacgcctgtaatcccagcactctgggaggctgaggcaggaggatcacttgagcccaggaggttgaggctgcagtgagttgtggtcgaaccactgcactacagcctgagcgacagtgagaccctatctcagaaacaaaacaaaacaaaacaccctgcaagactgggatagagggcaatggatattcccacaatgcacttttcctaaccctatgagaaacaaaccaaagacatttttggagaaagctgctttctggagcagtttcagttttatttttgtatttaaggctgaaggacagtttcaataaacatgcttcttcccagagggatttcaaagaaagatcgtttttgcatgtcatataggggagaatgaggacatgagacaccaagaagatgaagttttcaggagcagaggagaaactttacaccaacatgtctgaacttcattgactcactacctggagccattttttagctgttgagttaagaaacagaaaaaggagcctggggcttctgactctttcaccaggcttaggggagtgagaggagggtttagacacgggtagggcctcttggccccttggtgcagccccgctgagccatctcctcctttggctgggtgactcctttctgctgccttgacaactcctggaggagaaacagatggggcctctgggctcctcccagccctgtagggtggggctcctgccctccttcttgaagtttacctgttgctgccacaagttctgctcccttcgtctttcctttgaatcctgggtggtgcaggaactagccttgttcagtggacttggggagaactggaggggaaattcgctgtgttttctgttaagccagcactgaccccaacaactcccctctctagtccaacttcccaaaagtctaaactgaaaacaataaactcaccttctcatgaatcagattctgcaaacagatgttcaccttttgaatctgggctaacrgggggcgaccaggctctgagtgtaaatctgttagaaaattctagaggaggagttggaggctgacaacatggtgaaaacctgaggtcgtctgccactctattcctgtcaccacaggccatccctctcatctggatcccctcgtcccagtaccctcccaggcaggtgggaaaatccagtactctccacctccatctctttagcacatcagttcctccatctccctcaaatagcacaataccccctttcactactcttcatggagcctccctgtccatccctgccccattggaataatccaggccacaccctcatctccatggagtgatccaaatccctctgaatggaatgcagaccagcttcctccagccccaacaatgaacaccaacttaacacttggtggcatcctgtcattacgatgctgcctccaactcatgatccctgaccattaactctcccctctccagagtggtctcaggctgtgtctacacattccctgttcctccctccctggtcctccccccattcacacagaggggcagcccccatacctcaccaagggcccctagatgcagctgctgtcgctgtgcctccctcagatggtcttcaaaccaggcctggccatgctgtagcagctccagaccctgccacagggcatcctgttctctctccagagcctgcatcctgcgtagctgggaaaggcaatcacagaggctgactctcacgccacagtagggctctgggttatggccctttctctccacccctagttgggttcactgtgtggtcactgagtgtgaacccagactggccactgaggacctggagggcaaggggaggcaggcgggaacactgtgggccctcaagttgaatggaaatataaagggcagatctattgagagagttcccctgggacctcttgttgggctgatactcacccaaaggaagaagctctgggcccctgrgtcttggcggcttgtccccagcggcagcagcaggactgtgtagggagcctgcaccaagggcaccccgccagagccctggctccccatggctctgaggtgggaagggtggagccactcccactggtgcagcccgggctggtccctcccctccacccctgccttgcacccatcctgcctctgtcagcctctcaggccccttcctgctgtgtctgtctgaggctggggtgttcctacttgagaagagagaccatctcccttggacccctctgtcttccctctaatctgttttgtagggcctctctgaaggggttcgttctcatgaagtatcctggggtagaatccgggagtcttcctacagcaacaacactgtatttttactgaggcagggcaggttcccctgtggactcctgctctgtgttttggatctttcctagtctcttgttttgagactaaagaaacaatatctttcttcaaaataaactttattcctaatatgaaacaaaatttctagagaaactaaaaactctgcgtctgagggagataaggaaacaaagagggcatggcagcccaccggagtctcaggaggctggggaggacactggaaggactctcagaggatgctggtggcagcaggcagcacttcctggctcatgaaaacgttcaagtccaggttaggatcttccaaatccagtttcataaacttatccactaatgtctggcaactgaagaagagagaaaatcgcaagatttatggcagaatggacaaccaaatccctgggcagaggggagaggctgtggcacagaaaacctgggatcttgaagatttagggatttcagaaagaaatggtgggtttctgaagggcaaagtgctggaggaaggctgagtccctgaaaaggggagaagagttgcaggagaagatgcagagagggtaaagacactggggccatatacgcacttttccatttggttcttctttagcaaatccttgacagrcttgatgggttttccactgcggatcaagtctgagacctaggaacaagcaagaaggtgggaggagtaaggggagtggggaagagaaggggaaataagggtcagaaatcctgtggacctagacccaggcccagtaggactaggaatgaaagggagctctgatgtggaggtggttgcacatttggatctcatcacctccttgccacgagccacaagcttgtcaggaagcccagcctgggcagctgtgtgggaggcatggctggccttcgcaacaccttcgcaaacctgatagaagaagacaagatcgttgccatcctcacaggtctccatggtcttaaaagagaataaaagacagtgtatcatcaatcacctccttcctgtcctgaaacccttggccaatcctgtggggagggagaaaagggaagggatgtggtctctgtgctgagggagcccttgttctgatagaggagccaatccccacctctgggaaatgcccagcctgggggtccccgaggagctagattggtctcctcaccaaatactgcaccaggggcccttgtggcagcagytgtagctgaacaaggctcagaaagttggtggccacaaagatgtgggggcatgtgggtccacgtgccagccagtgtcggagcacagcggccagaagcgcgagcccatccacctgcaaagagggcagaggttagcattcggagccatggggaccccatatgcccctctgcacttgcactgcctttccctgtctcgtgttctatttcttttctgcccacacagccctattccattccagaggcccagcctcactgtcatgctccttcatcctcctccattttcccctccttagtttctcccctcatcagtttctcccctcaccgtgttggttccctttccaaattcatcaataaggaccagcgactgtgcagtggcattgttcactgctttcgccacctgctgggtataaggtggacaagggaaagttagtattggaagcccgtaacgcactgaccacagttggcctgtgaataaagctgtatacatgccctccctactgcactgcaagttcttgaatggtgaggtgcacgctttgttcatcctctttgccaacagtgactcacatgaaacaagggttcaagaaatgtttatggtattgattcttcttatctctgaccttagtgctccccacttttagtataaagggcatgcagcagagggcatgctttcctgttatgagcattttcaggggttcctttcccattatccccttcctcaatcccacctccctttgttccctttgacctggttgaggtcgatcatgaaggtggagaggccaagggagatggattcgcagctatgaattcgtgtgaagatggcgtctactgccccaatttcggcctcctctgctggcacaaagctgcctaccagggccatgaatgtgatcaagcctacctgaatagggaaggagacagggcctggggcctggtgccgtgggctgaggtgaaagtgaggctcaaggcatgaatggcacatcaaagagaaatggacagggtgaaacaggagaaataggtaacagacacactgactctgtctctcctccccgaatcctgaccatagccctgtgggctaatttagaatcagtgaagaggcacgggacgtgggcagagacatacttgggagtggtgtgtacctactcagaggcaggtgaaggaatttgggccacggaaagttccattagagcatggctctccagtggagaataagaacatgtgaggtggaagcacagggatgtgggtgatggtcctttcatgaagagcggggtcagaaaatgggagaagagctgcaggagcctgagttggctggcaagtaggggtggagtagatgcaggagacgccagaggcccaggctgcagggcttctcctcacctgtttgaggtatatgctcttccctgatgagttgggtccagtgatgactttgaccctccctttgtccccaccacattctgtggagttgggcacaaargttcgggcacagagttccatcagaggatgtctgcagtgggcggagaggcacctcgcatggcttgtggatcaagatagatgaacccccagaagatgtagcctttgggcccctcatgtctattcctccacccgcctctattcttacctgccattctggattcgtaccccaaggacttgtggggagtaacgcggccttgagtagccatagtcccgggcagcactggcaagagccagcaggacgtccaggcgggaggcaaggtccaatactcgggttaagacagctgctcgtgccagcacctggcactgtagctggtacatcagcagcgtctcctggtctgggagtgggtgaggaagggagctggaggtcagttccaggggaaa

SEQ ID NO: 10766 - DNA, 28475 bp, Homo sapiens
agctggacgtggtggcatatgcctgtaatcctagctactcgagaggctgaggcaggagaatcacttgaaccagggagtcagaggttgcagtgagccgggattgcgccactgcactccagcctggcgacagagagagactctgtctcaaaaaaaaaacaaaaaaacacacacacacacacacaaaagttagccaggcgtggtggcaggcacctgtagtccagctactcaggaggctgagatgggagaatagcttgaacccaagaggcagaggttgcagtgagccaagatcgtgccactgcattccagcctggccaacagaacaagtctccatcccaaaaaaaaaaaaaaaaaaaaaaaaaaggccaggcgtggtggctcacacctataatcctaacactttgggagactgaggcaggcagatcatgaggtcaagagatcaaggccatcctggccaacatggtgaaaccccgtctctactaaaaatacaattttttttttgagatagagcttcgctcttgttgcccaggctggagtgcaatggcgtgatcttggctcactgcgccctccacctcccaggttcaagtgattctcctgcctcagcctcccgagtagctggggttagaggcatgtgccaccatacccggctaattttgtatttttagtagagacagaatttctccatgttagtcaggctggtcttgaactcccaacctcaagtgatccgcctgcttcggcctcccaaagtgctgggattacaggattgagctaccatgcctggcctaataataataaaataaaataaaataaaataaaaagtagagaatggcaatgccccctgctcacgcatgggcaaccaactacagagcagaccaccagccataaccacactttcccctcacaccctttatagtaattcaccctttctttcaagaaaaaatagccagatgtgatggctcatgcctgtaaccccagcactttgggagaccaagataggaggatcatttgaggccagtagtttgagaccagactgggcaacatagcaagatcctgtctctacaaaaaatttaaaggtgcggtggctcatgcctataatcccagcactttgggagactgaggcaggcagatcactagaagtcaggaggttgataccagcctggccaaaatggtgaaatctcgtctctactaaaagtacaaaaaattatccaggcatggtggcgggcgcctgtaattccagctacttgggaggctgaagtgaaagaacatccctttccgtctccttcctcagtttacctgccaggctaaagctgacccctttgttgtgagtcatgaggcagcggatgattcttggtcttcggctcctgggctcagaaagcccctccccaggacacaccaagagcagggcagcctcactgccccagaaggactgaacacggcccytcacgggacccttcccttcctgccaggtcacagagtccatgcgtctgctggggaccacagagcacaggaggacattgcagggggatccatctgcagcccttgcagataactgggatcctgtaggggagagagggattcctcagttcttcacctggacttcctgggccacagtagcccctggtctgcatgcccccactcacctttgagcaccaagacgtcgtacaccctccagttctggtagttgtggtgctgacctagcacagygcaccagtaccgcccggcatcttcctctttggatccctscaaccacaaagaatagttccccagcagtctgagcctggattcccttcctggttttccagggtctggggctggcctgcccacttggacttgggctaccagggtggtgaaggagcctgctgcagggctgcagaaccatgacaggtgttcgtccccatgtagagtagrtggtgagggacatggcagctctactgcctcccccaaggccacatagatggcctgcatgttgtctgtgggaagagggttgtatgaggccagagacctccatcagatcaataaccccccatttgatcttcaaccctggcttccttcccttctggggtcccccagcacaggcctggctggtgaccacatttctcaagtgacagctacaaaaataagacaggtggagagaagagggtaagggctttcctcctctctcccccagccagtgagggggtctgagggcaagagggaaaaggctgaaagttggcaaatgcccacatctcttctactcatttctacttttctggaagcatttactcattcttcttattttataaaggaaactgcataacctggaccctcgttgcctctgggtcttccctagtgtcagaggcaggaggaggttggttggggtaattctatcttcttgagtcagatgccttcgccaggctcctaggagaaagagcagtagtccctccccaaccttgcaaatagctaaggaatcccgtacctcttgccccttacctgcagcctggggagttccacataggaacaggaggaggaataagactgccatggggagagcctgccaagttctcttgctccaagacctggtgtccccagggaggaagcagagtccagataaaggcccacactcgctggtctggagtgacaaggggctctggaggggatgggaatgctggggcgataaagcccagcagcatgtctactagggataaagtgaccaccacttttctatcctggagagaaaaggacccagcccaggccactctgaagatgacctttttgctcttctgattccacatcagctaaggggctcaaataaagactttccatgcaaaaaaccatgcagagaagtggtcctgcctgtctagctcttgtcagtctggaagtacattctgaggtctctttcactcctaagaaaggtcagccatgagttgggtggatcacttgaggtcaggagttcgagaccagcgtggccaacatggcgaaaccctgtctctacaaaaaatacaaaaattagccaggcgtggtgacatgtgcctgtaatcccagctacttaggaagctgagaggcaccagaatcgcttgaacccgggaggtggaggttgcagtgagccgagatcgtgctactgcactccagcctgggagacagagcgagacttcatctcaaaaaaaaaaaaaaaaaaaaaaaagaaaaagaaaagaaaagaaaagaaatgtcagctatgagtgaagaaactgagtttgagtttttatgttggtcctccacagaacccagcacaagactgtgtatcgagtcagtgtcccgtaaatgatttggaatgactttccctgtggttgtctggcataccccggacctctcctgaaaccctaataagtgtattaaattattactcagggacaaggctaacgggctgattcatccttctgaacggcaaaaactcctaaggcagatcttcatgcagttattacagttttaatgtgtaatttatttatttttaaaattattttgatgaaatattccatacataccaaaaactatatgaagtacaactatataatggataaatgcttaacagagtagaagactggacagcaatgagaatgaacaaacctagtgatttgcaacaaagttgaatctcacaatataatgagagtaaaagaagcctggccaggcatggtggctcatgtctacaatcctaacacttttggaggccaaggtgggagggttgattgaagccagaagtttgaggttgggcaacagagcaagaccccaactctgaaaataaaggccagacgccgtggctcacgcctgtaatcccagcactttgggaggctgaggcaggcggatcacgaggtcaagagatcgagactatcctggccaacatggtgaaaccctgtctctactaaaaatacaaaaattagctgagtgtggtggtggatgcctgtagtcccagctactcaggaggctgaggcaggagaatcgcttgaactcaggaggcagaggctgcggtgagcagagatcatgccactatactccagcctggtgacagagcgagactccgtctcaaaaaaataaataaataataaataaataaataaataaatagaatattccaggccggactcggttgctcatgcctgtaatcccaccactttgggaggatgagacaggcggatcacctgaggtcaggagttcaagaccagcctgaccaacatggagaaaccccatctctactaaaaataaaaaaattagcagggcatggtggtacatgcctgtaatctcagctacttgggaggctgaggcaggagaatcgcttgaaccccagaggcagaggttgtggtgagccgagatcgggccattgcactccagcctgggcaataagagcgaaactcggtctcgaaaaaaaaaaaagaaaaagaaatagaatattccaggccaggcacagtggctcatgcctgtaatcccagcactctgtgaggccaaagcaggaggttcacttgagcccaggagttcgagaccagcctgggcaacatggtgagaccttgtaaaattagccgagtatggtggtgtgggcctatagtcccagctactcaggaggttgaggcagaaagatggttgagcccagcaggtggaggatcagggcagtgagccgtgattgtgccactgtgctccagcctgggtgaaagagctagaccctgtctcaaaaaaaaaaaaaaaaaaaaacagaaaaaaagaatattccgtttcagtcagagatcctctatgctgtgtaaccacaattctgaattttctctttcttctccacttgctttatcattaaattttatgtgtttttgaatctaatatactagtatcacgtatacattcttctgtggctttctattttcactcagcatcatggttttaagatccagttcatgcataacagtaatgattcatttattttctttttacaaatattccgcatatcttactgtgctgaattttcgtatccaggaccatggtgtagctttccatttattgaaaagcttttcgtttacctctttctttttttattttttcaattattattgttattattttgaggcagggtctggctctgtcacccaggctggagtgcatggagcgatctcaaactcccgggctcaagcgaccctcccaccttggcctcccaagtagctgggactacaggtgggcaccaccacaccctgctaggtcttttttttttcccccttggtattttgtgtagagatggggtctcactatgttgcctgggctggcttggaactccagggcgcaagcaatcctctctcagccaccccaagtgttggaattacaggcatgagccatggcctggaactcctggacgcaagcaatcatccctcggccacccaaagtgttggaattacaggcgtgagccaccgcgctgggccagtttacctttatttatttatttagagacagagtcttgctctgtcaccaaggctgaagtgcagtgggaagatctcggctcactgcaacctctgcctcccgcgttcaagcgattctcgcgtctcggcctcccgagtagctgggattacaggcgcgcaccacccatgccaggctaatttttgtatttttagtagagatggggtttcaccatgttggccaggctggtctcgaactcctggcctcaagtgatccccccgcctcggcctcccaaagtgctaggactacaggcgtgagccactgcgccgggccgggccagtttgccttttcaataactttttatagttttcttcataaaaccttgcatttcttgtactagatacattcctagacaccttatgttttcggttactcttatcaagtactcctaatctcacccctcgtttccgctgtcgctctagagtctgccaataatgagacagaaaaaaattattgaaccaygcccggtaattttctgattctccgcgttctagtggtcttccactagtttcggaccactgctgtacccgtagctccaactgcgcgaaactcttctcaggaagcactgaaaatgtcgcaactcgcccggaggcggagccggtacgggctgacgtcaagggcacacaacmcctcagaggcagggagggcggggccggcagggggacctgctgctggaagagcagcggcccgagccggggccatggcgaagctgctgagctgcgtcctaggcccccggctctacaaaatctaccgggagagggactctgaaagggccccggccagcgtccctgagacgccaacggcagtcactgccccccattccagctcctgggtgagtcgagttcctccccaccgaagaacgtggtacagtccaaaccctttacggccttttgctccccagaagtgcccataatgggaaataaggggagcctgcttgtcaagccagttatccgcaaaatctgcgctctgtgtgcttcctgagttaaagtcacgcctacggactggccgcctcctttctttttcgctctttaccgctttctcattccgactgccactctttgttctwtcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccttgaatttcagaatgacttttacagatcctgtatccgtcggtcctcccctcaacccccgcccaacctagcctggagacccgagtcattgtattctggagagctggcgggtggtggtaggctgttctaaatattctcttcctttttatcagttgtctcattgtgttactgtctcctacaaactgcccgctcctacccacattctcttcttagtcaactactcttatttctgatgcttttctttccttcttagattgtctaggtgtcttttctttcttctcaaactaacccttctccccacatgcacgcgcctgcaatccatttgaaactaggctgtggaaaaggagcaaaaatcgtccaatgctgctttcacttttgcttccaaatccagctccctgtgtttgttcccatggtcaggggtgggaaattaggttcagagtgagggtgaggaagaggagtttctgtgggggccagggatgtttcaagagagatagtcaacgagactagaaccagaggacacacagcagggcttctgaaagggaagggaaaggacctgccagtgggcagggtccttaaggaggccatctgttttggcaggatacgtactatcagccccgtgccctggagaaacatgctgacagcatcctggcactggtatgtctaccctggcatctgggactctgcatctttcagacccacctgtcctcttgaacttagccctccctaacttgggagcaacagtgccctggggttgggggatgccctgggctctgcagcagacctctccaacacagacacacaggcacactctaaatgtgcatacttggcactcccctttggtatgtagcactgctttctctgggggcaacctgagccgtaaggaaaacatgtttactcttgggaccatctgcaggtgctaagtcctgcagttccccagtgacctgtcctccctggcaactaacctctttggctgcagggacagctgttctttctggcacagttcctgtgrtgacgtttgcgcatctcttggggaccaggccaggggctrtcctgagcagggccaattgaaaaggcttgattaacttgagtagacagagagactgcctttaaatgtgatggaattatgtctggagatggaagacataattcttccataattccagaggaagaaaatagagcctgtaccaaattttcccagcctccattacattgacacactacttttcaacaaatactgagcacctactgtattcatggtgtcatacaccaaatatgatatgatatccctcaggttgtccatcttgctcagagtgtatagtatatgcctggaatggcaggtgtgtgtgtgtgtgtrtattgattgcctgtccctgtctctctgctgcaggcttcagtattctggtccatctcttattactcctctcccttcgccttcttctacttgtacaggaaaggtcagtgtggtttcaaaggtggtggggtagcaaatgggcaggttgttggcagatgagccagctccctaaagaggagaggggacctgtgaagatggcttggcttccctcttccatcaggcatcttcttcctcttagggtatggctgttccaaacagggagtgtggggtggaggttggggctgaactgggaagaggagctgagggacattgcggagagggtctcacattgtccctctcccttcccaggttacttgagtttgtccaaagtggtgccgttttctcactatgctgggacattgctgctacttctggcaggtgtggcctgcctccgaggtaggtggagaggaaacctggtttgaatcttatctgtcactgtcactggttaaaaattaagtaccttgtgcaaatacattttagtgatgggcctccgagagggaatcattgagaatggtttaaggcatgatcttttccttaaaagacttgggttataaatatgaaaaaatwactgaaaagtaacaaaaaggtttgcttttttttttttaagagatagggtctcaccatgttgtccaggctggtctcaaactcctgaactcaaagtgatcctcccacctcagcctcccgaagtactgggattatagatgtgagccactatgcctggctgcttttatctagaaaagatgcatataccctacaacaattctatatatgtatacatactaggaaaactcctgcacatgtataaacaatatagatgtacaagaatacagcatacaacattgtttgtaataatcctaagctggaaacaactccagtggctacaaatagtaggatggataaaatatgttctgtgtggccgggtgtggtggctcatgcctgtaatcccagcactttgggaggcagaggccagtggatcacgaggtcaggaatttgagaccagcctgaccaacatggtaaaaccccgtctctaccaaaaatacaaaaattagctgggcatggtggcacgtgcctgtaatcccagctacttaggaggctgaggcaggagaatagcttgaacctgggaggcaaaggttgcagtgagacgagattgcgctactgcactccatcctgggcaacagagcaagactccgtctcaaaaaaaaaaaaaagttccatgcaatagccatgcaagagaacactatatagcaatgcaaatgaacaaactgtagctacgctcaacaacgcagatgaagccaggtgcagtggctcatgcctgtaatcctagcagtttggtaggctgaagcaggcagatcaccagaggtcaggagttcaagaccagtctgtccaacatggtgaaaccccgtctctactaaacatacaaaaaaaaattagccaggtatggtggtgagcacctgtaatcccagctattcgggaggctgaggcagtagaattgcttgaatccaagaggcagaggttgcagtgagccaagattgcgctactgtactgcatcctgggcaacagagcaaggctccatctcagaaaaaataaaatacaaaaaattaactgggcatggtggcacatgcctatagtcttaactgcttgggaggctaaggcatgagaactgcttgaacctgggaggcagaggttgcagtgagccaagatagcaccactgcactccagtctgggtgacagagcgagactctgtctccagataaacaaaagcaatgcagatgaatttctcaaatgttgtgttaaatagaagaagctaaccacaaaataatgtatgcagtatgttttcatttatataaaattcaaaagggatgtgcatgtttgaggtagaacaccgaagacaacaagggcatggttttcttttyttttttttttttttttgagacggagtctcgctctgtcccccaggctggagtgcagtggcgcgatctcggctcactgcaagctccgcctcccgggttcacgccattctcctgcttcagcctcccgagtagctgggactacaggcgcccaccaccacacccggctaggtttttttktattttttagtagagatggggtttcaccgtgttagccaggatggtctcaatctcctgacctcgtgatccacccgcctcggcctcccaaagtgctgagattacaggcttgagccaccrcgcccagcaagggcatgsttttctcaaaagttaggagagtgattacctggggtgggggagaacagagtgggggagagccctgctgagaggtggctgtgttctctttgttgacctaggtgatagtcacatgaatgtttgctttgtattttttaaactgaatatatgttttatgtacatatgttgtatctcgcaatttaaaaaaataaagaggacagatcacctacccctagtgggtacataagatgacaaccaggtgatgggcgatgcttcaacatgggggtggtggggtcagggctggatggtcrcagttgggtccaggaccttctgcctgaggtgttctgccccctgatctctgcaggrctgggctctctcctcagagaggccttccctgaccaccctgtctaaaagtagctcccactgctcagttttgtcttagttttttattttatttatttttaatttagaaaaaatacagaaaaaattagctgtgcatggtggcgggcgcttgtaatcccagctatttgggaggctgtggcaggagaatcacttgaacccgggaggcggaggttgcagtgagccgagagcacatcattgcactcccgcctgggcaacaagagcaaaactctgtctcaaaaaaaagaaaaaagaaaaaatacagaaaagtccagagaacaaaatataaaagcctttttaaattttttgatgtatagttttgtgattttttttttatatatagttttgtgatatttgctttaaatgctttctgtcaacaaaatactaaagcaccacagttagggttggagttcccattggaatcctttcagtcccatcttcctctttcctcagaagtaataattgtcatttggtgtgggttttttttttttctggcacatacttttatgaaacatatacctcagttcctcaagtctaagctgccatcaattgtaaaatgaattctaatttcagagttttcaagggttaaaaaatatacattttagaatctatgaaatatggtatctataagcagtatgtattattttgcacattttacatttttggcataaatgttgtacaaatcattctgcagcacacatcattctctcatcatatcgttttgggggaataccattgatgacacataaagttctggttcattcttgttgtattttctctgtagcacttatccctctctgaaatgttgtttattgtcttctcctggctgtacctaaccccaaccagaatgccagctctctgagagccaggagctgtgtatctcatttcctgctgagtctcccgtgtgtagtacggtgcctgtctgacacacgacacctgccaagtcagtgaggagagaagttagggtttgaggtggctcagcagtgaaaggagagtggatgcaatcactgactgtgtaagtgaaaagagagaggagagagagtcagcactgagagttgcttctgcttyagaaaggaaagcagaaaggaggcaggagaggaactgttcaggaactggaaggagtcaaggatgggcccaggaagcagaggcaggaagaatcttgagggacagggagaatgctgagtagtacagttgaagagaatgaggatagaagagtcaggaattcagtgaggaagtaattatgggcaggagtcggagactctgaagccagatggcaaggggctagaatatacagaaaagaggcagaaagcaaacattggagaagartggcagtgaaaaatagagaaatttgatattcgcaagggagaatagtattatatgatagtgtttaatagtgtcatttaataggttatatgacagtgtttaaagactgaggaagaggaacattctggaagatggtaggttaaggattgtctataaagacacaaactgcagaagctagggagaagaagcgtcctgtagccagttgctggatttggaggaagggggttggctcacatctatttctcygcatcctatgccctcagttcctttttctttcactttttcttacagggccttcttctagcccatctccaattcttttcctaaaacctaggctttctgcttcccagttttcctagcactgtttcctgtcctttttctaccaggcattggccgctggaccaacccccagtaccggcagttcatcaccatcttggaagcaacacatcggaaccagtcttcagaaaacaaggtgagaggccctaggaaaagtgccacacaggcacccaatagcagctttctcagttgtccctcagagcaccagacactggcttctgcaggaagaggaggtgtgttttaccacccaccacactgggtgtttgcttgcacattgctgtatcccttctcacctccattagtgaactgtccacctgaggaatttttcctccctaccacttctaatggaatattctgctagaacaatcttccccctccctcacctgtaagaactggctaaactagaaacattccacaatgtttcttttttctttttctttttttttttttgagatggagtttcgctcttgttgcccaggctggagtgcaatggcacgatctcggctcactgcactctccacctcccaggttcaagtgattctcctgtctcagcttcctgagtagctaggattacaggcacgcaccacccacaccctctaatttttgtattttttgtrgagacggggtttcaccatgttggcyaggctggtctccaactcatgacctcaggcgatytgcctgccccagcctcccaaagtgctgggattacaggcgtgagccaccactcctggcctctttttttttttttcttctttgagacagagtctcactcttactcaggctggagtatagtggtacaatctcagtttactacaacctccaactcccgggttcaaacaatgctcatgcctcagcctcctgagtagctggaattacaggtgcacaccaccacgcccagttaattttttttttttttttttgagacggagtctcactctgtcgcccaggctggagtgcagtggcgccatctcagcttactgcaagctcggcctcccgggttcatgccattgtcctgcctcagccccctgagtagctgggactacaggcgcctgccaccacgcccggctaattttttwatttttagtagagacggggtttcaccatgttagccaggatggtcttgatctcctgaccttgtgatccgcctgcctcggcctcccaaagtgctgggattacaggcgtgagccaccgtgcctggccaatttttgtatttttagcagagacagggtttcatcatgttggccaggctagtcttgaactcctgactgcagacgatctgcctgccttggccttccaaagtgctgggattataggtgtgagccactgtgcctggcccacagtgtttctttttttttcttttgagatggagtttcgctcttgttgcccaggctggcgtgcaatggcatgattccagctcactgcaacctccgcctcctgggttcaagcgattctcctgcctcagcctcccaagtagctgggattacaggcatgcgccaccacgcccagctaatattgtatttttagtagagatggggtttagctgtgttggtcaggctggtctcaaactcctgacctcaggtgatccacctgccttggcctcccaaagtgctgggattacaggtgtgagccactgcacccagcccacaatgtttcttagaaggtagttttctctgtatcacagcagctcagttctataaatgtttaattttgttgtatgcattgaataccatgctatccttgtttgtggatgggacaaggtggacaggtgtgtccactcctatgcctgggagtacagcatggtgccaggagggagaaaagctagggctcagtgtcttgggaattatgccaagccggctggtgctggactgtgattatctttgaggatgggctttggggccccataragctcttttctgttatgggaggtttctaggatcaaacagctatgaccaccatcatcacattcctggctactccacactatggagctgcgtaatgatgccctgtactatgctactggctgaagcatttggcacacaccctttctgatcctcacaacagctgagtgaggtggcattattacctttatttgtaaatgtgagaaaacagaggcaaaaagaggttaagtgacccattcggagtcatagagcaagaaagtggctaagtccagatttgagagcaggtctgagcaaagcctgcctgaaatttgcttttagtcatcttgttttgttttgccatttacctttttgtataatttttctattgctctctgttagtcaaattatttttgaaatgtcaaaaaatttctgtgcagaaaataaaaaccctcaaaatagagtgctaggagctcagggggtgggggacgaatatagtcaagtattaagacacagctaggccrggcgcggtggctcacacctgtaatcccagcactttggaaggccgaggcgggtggatcacgaggtcaggagatcaagaccatcctggctaacatggtgaaaccccatctctgctaaaggtacaaaaattagccgggcatggtggtggcaggcacctgtagtcccagctacttggaggctgaggcgggagaatggygtgaagccgggaggcagagcttgcagtgatccgagatcgygccactgcactccagcctgggcgacagagtgagactccatctcaaaaaaaaaaaaaaaaaaaaaaaaagacacagctcccactgccgtcaaaaaacgtggagctggtgaggtggttcatgcctataatcccagcactttcggaagccaaggcaggaggatcgcttcagcccaggagttggagaccagcctgggcaacatagtaagaccttgtctctaaagaaaattttaaaaattagctgggcatggtagcacatgtctgtagtcccagctactccagaggctaaggtaggaggatcacttgggcctgggagtttgaggctgcagtgagctatgattgcaccaactgcattccagcctgggcaacagcacgagaccctgcctcaaaaaaaaaaaaaaaggcatgtggactggctcagtggggtggcccgaggttcggatgggctgtagggcaacactgatccatggctgcaggagttgaggaagggatgtagttgtgaggatggaagtcagagcttccttcaacgggtggccccacatggcagaggagcccactgtgggcgtgacttccctcctctctgtctcactcaaccttgggtctgtcagtgtgatctgctgggagatttctaagcttctaagacagcaccctataagggacccaggtggggaatagaccgtgaccagccagcgacccctactacccgtcactcaaaagcactagcaccttcagccactcctcctggggrtgggtcagacttagttttttagaaaagcagagtgttaggttcttagcttggaagagggcagacaggccagtcctgatacctgatggggcataccatctcccctgattttctggtcctgttagaattttccatctgagaattgggagggtattgacctccgcttggtttccccatgatgtgtggggatcagacccctggataacgaaggtgttgttgagggtgggtaggagagcctcccctgagttctcagtacccctttgcctctcgtgcccactgcagaggcagcttgccaactacaactttgacttccggagctggccagtcgacttccactgggaagaacccagcagccggtgaggccccagttcttttgctgtatctctccccttagaaccattccagaaaatctctgctctgccctcccacctccatgccctctcaggtcacagtgcctgccttccaatgccattatgtcrttcctagaccccactgttctccagacctcagacatccagcttgctgctcctgaccctatccttccctgcatctttcccttcctcaggaaggagtctcgagggggcccttcccgccggggtgtggccctgcttcgcccagagcccctgcaccgggggacagcagayaccctcctcaaccgggttaagaagctgccttgtcagatcaccaggtgggaaacagcagcgaggagaggcccactggggtggaggggccatttcaggagtgctctgggagtgggcgctccattgtaaaatagctgtcactcattgggcctagtgctgtatggtttgtgtagatcatttatggcaaagtcatttttatccatatttatgtttgaagaaaagaggctcagagaggtctggagtctcaaatgtagtaagtaaagaactgggatatgaacaaaagctccttcagtgaggctgaaaaggagcagtgggggtggggtgggggtggggaggacacacacttgtagctagggcaggctctggtagcatctgtgtacccatcgtggcccctctgccctgttgttattccaccttggctccgggcccctgtgtgcctcagtgtctgcacctgtgatgaacctgccctgcaaggttgctgaggagattaagtaaggtaacatgttctgaagggctcctgccttgcctgggtgcttgagagcacatggtaaatcccaaataaagctcagtcgtgggtactgatgatgtcagaaggaacggaaataaccacctatatcttatagtggaacagacactgggaattttcttttgctgggagttaggaggcagcttctagaataccaaggaacagggtggacttagtggttggttgttgacagtgtgctaattagtcagggaggcaagccatatttgaggttttgaattataaccatcattttttaaagcattatttatttggggacctttaatatgttgtacttatattttaacagaatcataatctgatgataactttgcatttacttattatgtatagacagttacatcataaaactctcagaattctgtacatacaggatatgtgtgcactgagccacaatataaaatgtttatcttacaaaggttgcagtaagaaaagtttgcaaaacactagcctggtacatatttcattaaggcttgaaagaggaaagtaaagctgtgaaggtcaggggtaaagcaggccttacagtctgtgagtgctagggctgggatggtccccagcacagtccccaggcctcamcagggttggggtttgttaacctgtgttccccacagctacctggtggcgcacaccctagggcgccggatgctgtatccaggctctgtgtacctgctgcagaaggccctcatgcctgtgctgctgcagggccaggcccgactggtggaagaggtgaggcttccctgcccgcacatcccctaaagccctcccctctcacccccacccaccccgccccacccctgtgatgtggcctcctgacccttgcatcttggccattgcgtcttccgtactcagtgtaatgggcgccgggcaaagctgctggcctgtgatggcaatgagattgacaccatgtttgtggaccggcgggggacagctgagccccagggacagaagctggtaagagggagcagagagcccagaggtggggtgagtgtgaggaaggcagtagaggtctggggaccccaatgctatagcacctccctgaaggaaccactactggggataatctcatgtcctagctccacgctaaagaccttgtgatgtagtgaaaccctgtgatagagaaacagatgaagtaggagagacgttcaaggacgagaaactaatattaatagttaccactttgacagcacttcacacttatatatatttaattctcatatatatatgaagcatatatatttaattctcaaaagaatcccgtgagataggtactgcttatattagcccattttacaggagatgaaactggggcacagaaaacctttcctggacctcacagtaagtggtagagctggtatttggacccaggcagcctggcctcaaagtctcctacctccatgaagcagccgtggaaagagcgctaagccaggagtctagggagctgggttctagtcctggctctgcccatctgttatgagagttcatgcaaatcccaccattcgtgggtttcagcttggggcgccatggcattacagtttatctgaccataagactggagctcagagagggatagggagagcaatcagcataccacacaatagcaatggtcacagaagataacagacccgaaaacgagaaaggaaaaacatctccatagtccccttcctgaaagagatccagctggtaatcttccaaggaaaagacatggctgggtggtcgagcaggtcagcctctgaggagtatttgtaatccctttgcttctcctcttatggaccctgtggaatgagaagcttccattccccttggagaaaacagaaacctgccctttcctcttccctgcaaagctcttcatgggctgccctccctgcccaaagggagtttttcagtcccaacttggccccccagcccttccttcctgcctccttcctaggtgatctgctgtgaggggaatgctgggttttatgaggtgggctgcgtctccacgcccctggaaggtaggacggtgactcagcctccttatctccgccctttgaaagggaatgtccctgcctcccacactgacctgacctcccctggcctctgctttctctgggtgaggttttgagtctctcagctttagggaaaagtccactcgcyatttgctttgataaccttacatccctcccctggcctgtgtccctagctattatgcttttcattctgttccattcccccaccacacaccccacacaatcacatgctgctccctgtgctgcctcagaacctctggtgtcatctcctatttctgggaaggcttggagttatttgcatctaagctggggggtacttctgctcttccttcccccagggatggagaaagggctgtgggccacaaggtctcagtccytcctccccctgtgttacagctggatattcagtcctgggctggaatcatccaggctttgctggaagcacggtgagaccatctcaggaatcccttccttttcctgaattatgtctgtttccctctggtcagccattggagggaggagaggggctgtggatttcttgaaggcstcccactcacctgagggctggggtctaggaggttgtgaaggcagcattgggakccatgcycccatccccacagtgcggggctagcaggagaggaggaggtagatctcattgtacacatccgtcttctggagagaacaacctctcctaccatcccttccttctacaccttctctgcctgtcataggtggctgcaggaggggtccacgttgggagggacaggtgagctggcctttggtgctgacacactcctgactttgccctttctcctgcagggggtgccattcccgcagaatgaggctaatgccatggatgtggtggtccagtttgccatccaccgcctrggcttccagccccaggacatcatcatctacgcctggtccatcggcggcttcactggtaccagcctccctcccatcccccactgtagacacattcatgaccacccagccccacccgggagaggtggggaaatggggtggggtggaggctcaaggaagaagagagaggaagtagaatctctgagtgggcctggaagaagctatcctatttgcatacacttcacctttccttcccctcttgtgcccagtcattaaaaggaaaagcagacccaggtcctgggtggggagatcagggaaagtgaatgtttcctgcccattatcttcagtgcactatctccagtgttctatccccatcctctccagatagtyccctaaccaagtgaagtaggttaagaaaaaaacaagggataacatagggggaatggggttggcctatagggtcagtgggatgagagcatgggtggtggggagaaaggagcctttctcagttcttactcttcttccctgccctggtaccagccacgtgggcagccatgtcctacccagatgttagtgccatgatcctggatgcctcctttgatgacctggtgcccttggccttgaaggtcatgccagacagctggagtgagtgcagctcccaggcctgcccttcctgggaaggggtgggctggaactgggaactgttctgagatggctcccttttcttgggtggggagtaagtcgccccattgttggaagcaggaggaytcctttgtctgggggcctcagttttctttctccgtgaatagtgaggacctttatgttgggcaagggctttgtctctgccatcccttcacctttatcccactctagggggcctggtgaccaggaccgtgaggcagcatctcaatctaaacaacgcggagcagctgtgcaggtgagggccggccagcgtccggcattgaacacctgccccccatacagctctgctgggcgctcaaaccctgaaactagtactaaagtgcaagttggtaaaaggccactggctcacatcctgagtgaccctgccaccacctcaactggcctaacccctcccaggtcccctgggactctggaccacctcaggatctggcaaccaaagggttaaggcctggcacggcaggggtctcccagcagggccagactgaaccatgccccttaaataatcccctctcacccctgagtgaagggctaggtcaagggctgtgctatagcaaggggagggtaagaatgctaccagtgcagggataggggtgggccagttgtcacccgtctccctctgagctctcccttcccactgctctgttctctgaagataccagggtcctgtactgctgatccggagaaccaaggatgagatcatcaccaccacgtgagtgcgtgggaatctcggccctcaggaaccccagagatggccaggaacttgtcccttctacctctgcccaccagaaacctgggtatctagacccttcctcctaacctccagcccctccagggtacattcttctcacccccagggttcctgaggacatcatgtccaaccgaggcaatgacctcctgctgaagctcctgcagcatcggtgagagccagggtgtgtgcgcgctgggggcagtgtacacacacagatactgataccagcacagggaaggagggaggaaggttcagggatggtgaatgaaaaaaaatcagccctgacctgtcctggcacttcctccgtaggtatccccgggtgatggcagaggagggtcttcgagtggtgaggcagtggttggaggcctcctcacagctggaggaaggtgagaagggatccagtgaggcttggggcgggggcccagcaaggtcaggttgctgactggctgtcatctctctccctgaccagcctcaatttatagccgatgggaggtggaagaggactggtgtctgtctgtcctccgctcctaccaggcagaacacgggccygacttcccctggagcgtgggtaaggagctcctggggcaggagagagggtgggaagggcctaggaaggggatgaatacccagatgtgtggcctattttgagcgcctcctctctgcaggggaggacatgagtgcagatggacggcggcagctggctttgtttctggtgagctaaggagtgggaagtgggaagggttcttgaatggccagggctcacatagggggactggggataccctataagcattggaagtggcagcttttgtagagtgggtggtggatgcggaagtggagggtggggagggagtccagtggctgcccctcccaacagtgctctgtaccccacctgtcccacctcctttcctcaggctcggaagcatctgcacaactttgaggccactcactgcaccccactcccagcccagaacttccagatgccctggcacctctagggaccaactgggactcattatggaagaatggggtgagaggagacatgaggaaagaccctcttatttgtgattctctgtgttcatgttgctgtttatagtttgtgkaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcwggctaattgtataacttctcaagtgtccagggagccaggggcaggtagtggggagagcagaggccccaaagagctgggctttgggaaaccctaactctagacaatctagctaatctaacccttcccatctctgtgtccccctaggccttcagcccctaacctgagctttcctcaggcagcaggtccccaaacctccccggtccctgatgtgcctactgttatcacaactgtgcagcctccctggcccctcccgcctccttcttcagttcttcctgcatacaaccaccccaggagcccatggttgccccctcctgcttacggctcatgagctttctaggatccgatttcacctacccagtgcttctgctggtttccaggttcaacctgcatggtgttactagcagtacccccaattttcattgctcacctcttgttatcttggtgaagagtgaggaagggcctgctccccacgtcttatgcagcaaaccctgcacacccaccttgccatgtcatcaagtctctgtcctcacagcctttttgcagttcaacaaacacaggccctgccagggacggagggccaggtgccaaggactcatgtcttctcagagccatactttgccttttggacggctctgttaggagaagatgcttaggttgtacctgaggaaattggttccctataactgccatctatctctaactttggaccttgtggaacacagtgaataaatccctcttccacccattggtttgttgcctggcagttttttttatttttttggagatggagtcttactatgttgcccaggctggagtgcagtggcacaatctgagcttgctgcaacctccacctcccaggttcaagtgatcctccagcctcagcccctctagtagctgggattacaggtatgcgccaccatacccagttgatttttgtatttttagtgaagatgaggtttcgccatgttggccaagttggtctcgaactcctgacctcaggtgatccaaccgccttggcttcccaaagtgttggggattaaaggtgtgagccactgcgcctggccgctggccactttcttcatttggaaacttctcttttccagatgaaagaccccaaagtttatcgccctgagtccatttttgttttgttttattttgttggggatggttttttgtttgttttttgagatggattctcactctgtcgcctaggctggagtgcagtggcacgatctcagctcattgcaacctctgcctcccaagttcaagcgattctcctgtctcagcctcccaagtagctgggattacaggtgtgtgccactacacacagctgatttttcgtattttagtagagacaggtttcaccatgttgcccaggctggtctcaaactcctgagctcaggcaatccacccacctcagccgactccattctttttttttttttttttttgagacggagtctcgctctgtcacccaggctggagtgcagtggcacaatctcggctcactgcaagctccgcctcctgggttcacgccattctcctgcctcagcctccctagtacctgggactacaggcgcctgccaccacgcctggctaattttttgtatttttagtagagacggggtttcactgtgttagccaggatggtctcgatctcctgacctcgtgatccacccgcctctgcctcccaaagtgctgggattacaggcgtgagccaccgcgcccggccaactccattcttttgagcaagatacttaacgtgggcgacaatgttctaatgtcctagatggagtctctggctaaatttctgtgtcttctccaaacccagtgcatgaagctcttcttgaaaccccagggcagaggctgtgtgtgcccccattagcgctgcaactccttaagggaagatatactgagtctccactggaagtggagatctgagacttaatcaggtgatgtgatgcctgaaatttggagttagaagaggcaggtgaccacagctccataatgctccaccgttagcaaacaggtggatagctgatactggtgccctctcctctatcccattccaggggggcaaacgatgggaagtgtggaacatgaagctctggagccagctgcacagttctgaatcccatcctcccagatccaacagaagagttaatcccctgaaaactaaatttttgttcagctaagggaagctccttaaatgcaaagaggagctgggcatggtggctcacatctgtaatcccagcactttgggaggctggggcaggaggatcacttgagcctagaagttcaagactggacagggcaacatagggagactccatcagtacaaaaaatttaaaaattacccaggcatggtggcatgcacccgtgttccaagctactctggaggctgaggtaagaggatcgcttggctgaggatcacggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactgccactttcccccatcttactgcatgtaattgtagacaacagtggatgacctgaggggcccttagatacctgaaattgggtagggaaagaaaggtaggctcaacatgtgaattctgaacccccccatccaggggcctcagcctacttcagattactccctatgcaataaggttcagagcagctgtgtttgttttcagaactaatccccacccaggggtggaagcaggcccctgtccactcctcaccctatatagcaaagttccagcagttccaggggatgatcagcagagatgcagaccttcccagttgctggggcgctggaccctgctatactggacacaaggtgaggcctgaaagtccaggcaccctgaggagctgggcaaactagcagaaaagatggcgctgggagaaaggaaagttagactctggacgggaaatctggaaagaagtggttcccagctgggccaaaaagcctcatcctacgccgtctcatcgacctgggctccaccctgagtgcctccagtgtgaggtgctggactggctctgtgctgcctgtttgggttgagggtttgctcctaggagaggcatgtatttctcgtacagctgtcacaagcgagtgagggctccggaggtggagggcccaagagggtggggagctcaggcgtcagtgatagccagatttccatccatcggtccgtccgtccgtccatccatccatccatctatccaatcaacaagccattccggattcttcaggaatccagtcattcatttatatttaggttaaagaccctctctctggttcctctctagaacgcaatctcgagccgctcccccaacaaaccgtggccctctcccgaccgggtcatctacagccccgcccctcgtttgcctggctccattcccctaaccttggcgttctgtcctcaggccccgccttctttgtttcgtcactcggttgcttaccctcaggtatcccttaactctaggtaggagcactcagaagggacaccgtcatctgctgctgtcgccatggcgattattcaacgccctgcctcttcaccccaggaaaaccttcgcggaacccgtcaccatggaaacgaactctctggactcttagcgcgccctgggctggccctgctgggtggacaggagaggagcaaaacgcaacaaagacgggattaattactcggaggccgcgccccctccgaagaaggccccaccctgccccggcctcacccctccccgaaataattcgaggaaatattccgcgaatgctgggtgggtgtcttgccccccggttccctcaaggcccacggtcgcttgaattccacagcaagtcctcccggacctctcagggcaatcccctcccgaagcccagcctcagcctcgcaaagcctctagtcgttggccttttcgttgcgattatattcgagagggagcttcagagggcgccgcgaagttcccctgtgcttcccctttgccctttgccctcttcgcttcaagaggagccctggctctctttttttttttttttttttttttttgagacggagtcttgctctgtcgccaagctggagtgcagtggcgcgatctcggctcactgcaacctccgtctcccgggttcaagcgattctcctgcctcagcctcctgagtagctgggactacaggcaggcgccaccactcctggctaatttttgtatgtttagtagagacggggtttcaccatattgtccaggatggtctcgatctcttaaccttgtgatccgcccagctcggcctcccaaagtgctgggattacaggcgtgagccacggagcccggccctctgattctttttgtctatcactctgtgcactcattcattcaagacatttatgtaggtgccccgcgttcctctgcagttctccactactctggcttttctctaatacaatttattttgtgttattatttctttaagacagagtctcactctgtcgcccaggctggagtgcagtggtgcgatctcggctcactgcaacctctgcctcccaggttcaagagattctcctgcctcagcctcccgagtagccaggactacaggcgtgcgccaccacacctggctaatgtttttgtattttttgatagagacggggtttcaccatgttgctcaggctggttgcgaactcctgacctcgaatgatcccccaccttggcctcccaaagtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaatatagtttttaaattcattcattccaaggcttttgggaggcgctcagtggcgtgcagtttcctctcgaatttctttcttcccgcagtctttctgggcgggcgtctcccgtctgtttcttcccatcttcccccttatcatcctgggactggataattcttgaatagtctgggaggtagcagggaacccgagttcggagcctcgaccagaacctccagacgggaaattggagcaggtggtgtcgttccaggacgctgaggaccacctcctcccctaacgcacagcccaacgatcctaaaagtaaaaaccctgagtttctgagtcaagactgagctggtggggtggggaccgagtaggcgtggatggggagcccagcgggtccccagcggagaaaatgggtgagacgcctggggccgcggtctccagaattcgcctgggagggagagtggcgctacggcgccgccttcctggggagccgcttcgggctccggatgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcacaggcggggcaggaaaaaggatgaggtgagggaaggcgctgggttcctggaaccccaagggagcactgagctgagtacgtatcgcttgggatccaggtgtccttgttttaggatgtctgacaggtgtccccagggtatgagaagtgggactgggcaccccctatttgctttttttttttttttttgagacagaccacatgtttcctatcttggaaaatggtaccacttccttgtgcaagcctacccctgttccctcacccctcgttcagtccaacagcaaatctgtccagtcttctaactgtatctca

SEQ ID NO: 10767 - DNA, 40947 bp, Homo sapiens
  misc_feature (1)...(40947): n = A,T,C or G, or insertion/deletion polymorphism (see Tables 1-2)
tagctgtagctcctttgtttccattgctatataatattccattgtgtgactctaccacaatacatcctgttggtggtggtatttggtctgttttcaatttttggctattatgtatatggctactatgagcattgtatgactgtcctgatgcacgaatatgtgcacttctgtaggcacgtatttaggagtgcaattgctggttcatagggtatgtttgtttgactttagtggttttaccaaactgctttacaaaggggagtttgccctctcctagcagtgctcacgttcttcatatatccactaacacttgttagctctagaccttcagagatgactagcaggtgggtgggtggttatagcccccttcatctgtaaaatagctgaaatttaaataaactgtttgataagccttttttttgaatgtatagaatacaaaactattcccttatatatcagcttaatacattttttcatatgtaggctgttgcacttcaggcagccaagctgagtagctggatgtctagccagaaaagcaggggtaggatctaagcctgcctatcctctagcccctcctggtatggtctctgcccctagcttggcctgagccaggttggggtctcccaaaagcagcccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggtgggctggtgagcaggggctagggaagtggcagtggagtgcagctgatgctaaggccaggcctgagtgggtgcctgtcggctgcagtgaggagttttgtgaaatcttccgggccaaggacaagacgacaggcaagctgcacacctgcaagaagttccagaagcgggacggccgcaaggtgcggaaagctgccaagaacgagataggcatcctcaagatgtgagtttgaggcctgggattggggcggggtgggaggcagcagggaagggcttagagggcaagtggcctcaggcagtcccagcctctggccaattagtctgctgtggccactgtggtgaccacagcctctcccaggggttcatccagccctaactactggctcccctccctgtcgccagggtgaagcatcccaacatcctacagctggtggatgtgtttgtgacccgcaaggagtactttatcttcctggagctgtgagtgtgggtctggggacccaagattccccagcgcccagggctttcacctgtcccaccctctgcagctaaggaaaccccctttctggacccttggcgtcccaggtccctgtgccttgctcagccagctgcctggcgtaggcagctcacccaagtgctcctgccctacccctgattctgcccacgccaggctcaggggctggtgtccctcagggccacggggagggaggtgtttgactggatcctggaccagggctactactcggagcgagacacaagcaacgtggtacggcaagtcctggaggccgtggcctatttgcactcactcaagatcgtgcacaggaatctcaaggtgagggcagagccagagtcaaagggccagttggcagctgggctggtgctggggtgggcagcacctcagggccttggtctagcctccaaggtcctcatggtgtcttctgctcacccacatgctattctcacaccacagctggagaacctggtttactacaaccggctgaagaactcgaagattgtcatcagtgacttccatctggctaagctagaaaatggcctcatcaaggagccctgtgggacccccgagtatctgggcaagcagggggtggggcaggggcagggggataatggggggcagccttcagggagctgctctgggcagggggaaaatgtgctcatctcaggaagctggtgtggatggtactggacctggctaggcctgatactgaccagcagatgggcgctgtgtttgtagccccagaggtggtaggccggcagcggtatggacgccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaayccacctttctatgaggaggtggaagaagatgattatgagaaccatgataagaatctcttccgcaagatcctggctggtgactatgagtttgactctccatattgggatgatatttcgcaggcaggtgaggaggtgcctgcccagcacttggtagaacgcaagggagtggggagggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtgagcagggtccaggggagggtgggagaggccagggtccccctcacacccagcagccccatctttgaggcctagaaggggtgcaggtacctagagctcagggcagcccagaggctctgcctggtagtccctggatgccacatagaagggctgagcagagtctccacaaaggctcattctctcagatccagacacacttgcaccctttccaggatttctggcaatgctgcttctgataagaacatcaaggatggtgtctgtgcccagattgaaaagaactttgccagggccaagtggaaggtaaggcttggataactcccttcttggctctatcccaagtattgcttctggcactcagtttcttgcctgcatcacacccctgcagccacacacaagcttttctcaggccatcaggtgtgggtgtagccactgtgattaccttaagtaggagtgctgagcagctgagtacttggccctggggtggatggaggtggccgggggtactatggaaggagtttggtttggtcactgccaagcaatggatccagcaagcctcacccttagcctttctccactgtgctcctttcagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaargttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttaytttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcarcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcstggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttrgtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcactgcaacctccacctcctgggttcaagcaattctcctgcgtcaacctcccgagtagctgggattacaggcgctcgccaccgtgcctggctaatttttgtatttttagtagagacggggtttcaccatgttggccaggctggtctcgaactcctgacctcaagtgatctgcccctctcagcagattgttgttgttgttgttgttgagacagggtctcactctgttgccaaggctggagtgcaatggcaccaacacagctcactgcagccttgacttgggctcaagcagtcctcccatctcagccttcccagtagcacatgccacagccagctaattttcttttcttcttcttctttttttttttttttttgagacggagtttcgctgttgttaccctggctggagtgcaatggcgtaatctcggctcaccgcaacctccacctcccaggttcaagagattctcctgcctcagcctcccggggtagctgggattacaggcatgcacctggctaattttgtatttttagtagagacggggtttctctgtgttggtcaggctgctctcgaactcccgacctcaagtgatccgcctgcctcggcctccnnnnnnnnnnnnnnnnnnnncccgcctcggcctcccaaagtgctgggattacaggcgtgagccactgcacctggcctacctaaagtctttgtgggcatttcttctggtttgttttcatagtgcttttttttcttgtgtacctgtttacttaaaaaaatgtttttttggctgggcgcggtggctcacaactgtaatcccagcactttgggaggccgaggctggtggatcacgaggtcaggagatcgagaccatcctggctaacatggtgaaaccccgtctttactaaaaatacaaaaaaattagccgggcatggtggcgggcgcctctagtcccagctacttggaaggctgaggcaggagaatcgcttgaactcaggaggtggaggttgcagtgagccgagattgcaccactgcactcccgcctgggtgacagagcgagactcagtcttaaaaaaaaaaaaagtgtttttttggctaggcatgatggctcacccctttaatcccagcactttgggaggtggctggattgcttgagcccaggggtccaagaccagtctgggcaacacagtgacaccccatctctacaaaaaagtgaaaaaaatataaattacctgggcatgatggcctgtgcctgcagtcccaactacttgcaaggctgaggcaggaggatcgcttgagcctgggaggttgaggctgcagtgactcatgattgtgctgctgcactccagcctggatgacagagtgagaccccatttcaaaaaaagaacattttaaaattgaagtataatatagttcagaaaagtacacatattctaagtatatggcttacagaatgtttacaaattgaacatatctatgcagccagaattcagatcaagaaacagggtatggctgggcgtgttgattcacgcctgtgatcccagcactttgggaggctgaggtaggcagattgcttgagcccagaagttctagaacagcctgagcaacatgatgaaatctctactaaaaacacagaaaattagccgagcatagtggcatgtgcctgtggtcccagctacccaggatgctgaggtgatcatcacctgagcctgggaggtagagtcagctgtgagccatgattgctttactgcattccagcctgggtgacagagtgagaccctgtctcgaaagtccccccaccaaaaaaaaaaaagaaaacaggaaaacgcaggctattggccgggcatggtggctcatgcctgtaatcccagcattttgggagtccgaggcgggtggatcaggagtttgagagcagcctggccaacatggtgaaaccctgtctctactaaaaaaatataaaaatgagctgggcatggtggcgtgcacccgtaaccccagctactcgggaggctgaggcaggagaattgcttgaacctgggaggtggaggttgcagtgagccgagatcgtgccactgaactccagcctggctgacagagcaagactctgtctcaaaaaaaaaaaaaaaaaaaaaaaaatgcagactattatcagctctagaaaccttctagaaacctccttatatgctcttccaacccctaccaacacctccctccacctccccatattaagatagctactgtcttgactttgagagcatagatgaattttgcctactttttttttttttgagacagagtctcactatgtccctcacgctggagtgcagtggcgtgatctcggctcactgcaacctccacctcccaggttcaaacgattcttctgccttagtctcccaagtagctgggattacaggcgtgcgccaccacacccggctaatttttctatttttagtagagacggggtttcaccatgttggtcaggctggtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgtagactcatttattcttgctgtgtagtattccactgcgcctggttactcttgattatatgttgtacatggtatttgaaaacttatgggaattttagctgggcatggtggtgcacgcctgtggtcccagctactcgggaggctgaggtgggaggattgctcgagcctgggaggcgaaggttgcagtaagccaagatcacaccactgcgctccagcctgggtgacagattgagaccccatctcaaaaaaaaaaaaaaaaaaaaaaaagaaaagaaaagaaaatgtacttataggaatctttgaggccaggatgatggtatcattttccagagaggacttagtttctccctggtccctaggagtaggggagtctactagtaggagactaattaaagtttaaggcttgagctttgctggaccacctgcatagatgatgcaaagctcagctgtgttttgcttttaccactacttacttttttttttgagatggagtctcgctctgtcgcccaggctggagtgtagtggcacaatctcagctcactgcaatctccgcctcccaggttcacaccattctcctgcctcagcctcccgagtagctgggactacaggtgcctgccaccacgtccggctaatgttttgtatttttagtagagatggagtttcaccatgttagtcaggatggtctcaatctcctgaccttgtgatctgcccgcctcggcctcccaaagtgctgggattacaggcgtgagccactgcgcccggccactcttttttttttttaattaaaaaaatttttttgattgggcacagtggcttataccaatagttccagcactttgggaggctgaggtgggaggagcacttaagctcaggagttgagaccagcttgggcagcacagtgagaccctgcctctattctgtaaaaaacaaaaaaacaaaaaatttaatttaaaaaaattttatggctgggtatggtggctcatacctgtaatcccagcactttgggaggctgaggcaggtggatcacttgaggtcaggagttcaagaccagcctggccaacatggtgaaaccctgtctctactaaaaacaaaaattagctgggcgtggtcgcgcatgcctgtaatcccagctacctgggaggctgaggtaggagaatcgtttgaaccaaggaggcggagtttgcagtgaaccaagatcgtgccactgcactccagcctgggcgacagagcaagactccacctcaaaaaaaaaaaaaaagttatgagtacatagtaggtatacatatttattgggtttatgagatattttgatgcagggatacactgtaataatcacttcagggtaaacagagtagccatcacctcaagcatttatcatttttttgtgttacaaacattcctattcttttagttactttaaaatgtacagtagattattgttgactgtagtcactctgttgtgctatcaaatactagattttattccttatatctaactttatttttgtacccttacttacttttatttctggttgatccttaccttgaaagtgtagtctttgggattccagcttaaaatgggggtgttatcagagtcctyatctctgagggcccctgagcttcgactatcatctctcccaaccccagtcaaagcccagaatgttgcctaaaggacagcttttggccaagccaacagggccaaaaaaagggccagctggttggagtcctgagtacccatcaggccttgcgggaggtgctgtaactgcctatgctactgtcctcttatttgggcaggcattgggtcaaggaggagcagaacagaccctttcgtggtcagaatgtttgcctggcttatgtccccagacaaaccagggctcatcagtctattgttctgcttttcattccagcctaattcagtggtttgagacagcaccaagtcggacctgcccacagtgccgaatccaggtgagagtattggggtgggaccacctcaactgaagagatctccttagcagagagcaggaatgtgaaaagagctctgaaactgcaatatctctgaccttttttggaccctcctggtttaaggccagttgagcctcacttgtgcccttgagtgtttgggaggtctgcttacacccacaggtagctggcagatggacttgttgcctgggccagttttcacttgggtagatttggctggcctccttccctgtcttttcatcagtgactccgcacctagagttcaggtatcttttgagcacttaaccgtgtaggtctgtagtaatatgacttcagtgaccacgaaaccagcagccccaacttggggtacctgcaggagtaaagaggkcttttgactctaaaggatgtactttgaaaaattaggtctgagaacaggcctgacatgcatgtcaggcaggtagtcagacccatgtacaacactctyctccttgcgcatgacccagctacacaatcatactcttaccttgttctcccatccaggttggcaaaagaaccattatcaataagctcttctttgatcttgcccaggaggaggagaatgtcttggatgcagaattcttaaaggtacccagaatttatctgattctactgaactccaagccttgtgcragttcacttttcttttttcttttcttttcttttttctcttctcttctcttctcttctcttttctcttttcttttcttttcttttcttttctttttttagagacagggtcttactttgttgcccacactggagtgcagtggtgcaatcatagctcactataacctcaaactcctgagttcaagggatctccccacctcagcctacctagtagctaggactgtaggggtgcaccaccatgctcggktaatttttttattttatttatttatttatttatttatttatttatttatttattttgagatgaagtctcactctgtcacccaggctggagtgtagtggcgtgatcttggctcactgcaacctctgcctcctaggttaaaacaattctcctgcttcagcctcccgagtagctgggactacaggcacgtgccaccatacccggctagttttgtgtttttagtacagacggggtttcaccttgttggccaggctggtctcgaactcctgacctgaagtgatccacccacctcggcctcccaaagtgctgagattgcaggcgtgggccaccgtgcccagccctaatttataaaaaaaaatttttatagagatagggccttgctatgttacccaggctggtcttgaactcttaggctcgagcaatcctcccaccttggcctcccaaagggctgagattacaggcatgagccactgtgcctggcctgggagttcactttctatttccacataagtggagggttcctggaatatggagatgaagttatagaggtgagacttggtacagttttcaaggtggggacacaaaaatcagaggacaactgatgagacacagtcatcagagaaatgcactgtgagggaagaggggagctgcttgactgtaaaccctccctttgggatttcaggtcaattccaacctgaattctctcctgcggtcttgtctcctcatcttttaaagaacctacagccatcctgtacagcctactttgctgcttggacagttagtgacagattagaaaactcttctactccccagccacgggagatttttggattcagtgttccctagcctgcctgtgcctcaaaattgcctggggaggctgggcgtgatggctcacacctgtaatcccagcactttgggtgaccaaggtgggcagatcacttgagcccaggagttcaagaccagcctgagcaacatgggaccccatctctattaaataaaaaaagttaaaagaaaaaaaattgcctagggagcttggtataaagtcagatgcctgggccttccccagaccagagctcttggaatcaagagttgcagctcaggtgggaatggatatattaggggaaagtgggtagtttccctcctatacgtctaactgcttcccctcctaatctaaaatttagctttttttgtgtgcaagcaggctgcgttggcagagaactcttgaggaagttggatttgggttcacaaatgatccctggactctgagggttaatttgctggatatctgtcagatcagagttcatttggctctggccccagggtgtcatgatgtccttggaacctcactgcttcaggaacatggagcttttgtgcttagagcaagcatgttcatcgtcatggtaactgctcccagttttaagtagtgtcttccctgtgatgaaggcaacaaaggcagtttcatttatttccagctttcaaagccaggtttgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctggattccatctagctaccaccatggacccttggtcaagcgtttcagttttgtaaaaccttggatttctttgttatggagcaggcacctctcttgctcatggggatgttgagttctgtggcatcctgaacaggaactgggttcaattctgccacagcttctcaatgattctgtggcatggctgtgaaacatttgcaggggctttgagaggctcacttgatcctcacaatagtctagttagagactagacacatgggaggtttcatccaggggtacaaagctgtcctggcatagctacctccattggatactaggtctggaaggtttgtggtacacagagccagttcagagcttggaggaaagtcgactatgaatcaggaagacccagggtggagaggaggagtagtcgcccaaggtccttggccattcctattgtgtgtccctggtgagtcagctgatgcccagagggaatgagaccaacatagagcratgaggccaaggaagtgatagaaacttctgctatggagactgatcacaggggccctactttaacttcccttccactattctacctctttacctgtcctggggccttgcccctgagattgttttcctccatcttacctacttttcaaaagggcacatagagctacagcagtgcttatctttccattgttagcttagcttggccttgaggcactgcaggattcatgccctagaaggcctcattgttcaatcctggggctccccacagccttatgggagaccacgtggaggtcagctatgatgctttcctgctgcttattgtgggtattgcctttcagaatgaactggacaatgtcagagcccagctttcccagaaaggtgagttagcaagagacgaggggtgctgggaagcccctgacttggatgctggaggaagggggccctaggaggaaggtttcaaaccgtttgggagagccagggcctttccctgctttgtatgtccaagagtcctgctagctgttgtggtgggcagaaaaagagagggaagggaggtgactgaagctgttcacctagaccaggtgagcctcttgtctctgagtgcagcttcttgcccaggaaccaagatgggagggggttacctgatgggactgaatatcttcgggagagggctcagctgctgagtttggctggaacctgcttgagtcctgggttgatgaactaactggacccatggcaggtagggaatgggcagtaaaatattttcctaagtagttcaagcagcagaaggtgggcttttccctgaatgaaggctctggctcagcttctctggtttggcacatcccagagaaagaagcgggccacccagctttcaggcctgagccttgtttctcacctgcctaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcawcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgagrctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttggatggtgaggcctgggtttgtgctctggacttcttcagccacctgcacaacatgtaccatgaggcccagaccactggaccttggcagcccacagtgggcctgtaaatgctggcagtgggctgtgtctactgtaagatacctttcaggaggaagcaggcagggaggtgaagaagcagctggcttagagccttttagaagaagaagcacaagcgagagtgggacccaggagctttacctcctggggtttgggagtacatggttatcagcattttcaaaacataagctgcagagagttctggagcagagttttcctagtgactttagcaatggctcctgagggcctccaagcatcaggtatgggtgtatttgctcttcagaagcagatgaagtacttagagcagcagcaggatgagaccaaacaagcacaagaggaggcccgccggctcaggagcaagatgaagaccatggagcagtgagtttggagctgggtcctgcactgtgcctttgcccccagggcctgcaagtggtacagttcttaggactgcagcagggagtgggattgggtcatgtccgaggctcaaatctccataggccatggagggctcaggtcagctgggtgtgggcacagatcttagcctctatgaactcttcccccattccaaggaatgggagcccttgccacattcctccctgtctctgctgcctgtggccagatgacctggtgggtctttccttccagaaacctctctccaggaaatccctgaccttgagaccctctttcagcacctcttctttctcagcagcatccttggagctatgctcatctctgccacagggcctttccttgggcacacccacctactaaagcatcctggcagcctagcctgttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccrtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagtgctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgcyacctggtacttgttgggctcaggtgtcaaagtaggaatgagagtgagttgaggggttgggcrgtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggatttgttttcctccagaagcaaggtaacttagcagtgaacagaggytgaaggagaagtggctctccttttgtcatgttcactctggtctcctgagcaaggccatgggacctgatggcacagctgactccctggggcagctggaggacttacagaaatttgttaccagtccttactgsgcattggcctgaatatgtggcttgtccactaggggtggacagatcacagaggtatcccccaacatgtggacactgatgctcccctctgctcttcctggctcctgggtacctctcagctggctggagagcacaggcctcaaatgtgacagcgtcagaggcctatttttgtaccacatctggagtagragggctcctggaacctgattcggtcagcacagctgcttttacttctggcatggtgcatccacaggctgcaggatgtaggaagcagcctttgcttctaggcagctccggatgtgcattgccagactgaggcctagcctcagagagctgggatctctgcccatatctctagtctcttctgggctaccttgatcactccctggggagcagcaggagggggcagggcacaaggctaccacttggcttgtctttcattccctacactttcttatagttgcagacagtctactctgaattggatcaggccaagttagaactgaagtcagcccagaaggacttacagagtgctgacaaggaaatcatggtgagggacatccctggcttgacaggaatgaggggtggtttgtgtgccctcccagagcagggctgggctatctctgcccaggacccttgcaccagtcagtggtggttctgggcccctgcatcctcctgggtcagggtgtgccccttggccctggtccggactggagcctgggcctcctcaacagagggcagacagaaccatgagtcttccctcatagtctgtcctgcacttacatccctgaggtcccttatcagaggaggggctctacctggggcttggcctcctgagcctaatgatgaggtatcaggccttgctctgttcccagtgggctggcctttcatgcatgctgctcatgtcctctgcattatctcyggacttgatgcctcagcctttctctcacacacttttctttccctccccaagagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctggtaacagtctttactcctcctggctttggtggggtgggtgacctctgtggacctgatgtctgcagacagcctgccctgggagccagccaagatttagctggcaagcagccttgaagcaaattaggctctgacacggagaggccagagaaggccagaggacctagaagtggtctgagaatagggcagaagcactgactgtcttggggcatcctgtttatggagtagctccccacatttatctgtccaccccagattttgaaacaaatatgaaaccactgtaaaataattcccttagtgccaggagtgcgtgctttaaagctgccagcagagggagccacgaggcagaaggattggtgtccctgcaagcatgggcatccatttctgctcctgagagtttcacagaagcagactagctgagagcatcctcaaggctacctcctgcctgccaaaagtccccagcaaggacccagacagaaagcacacaactcctgtcagtggccccagtcttttttttttttttcctttttctttttttaatggagtcttactctgttgccaggctggagtgcagtggcactatctcggctcactgcaatctctgcctcctggattcaaacaattctcctgcctcagcctcctgagtagctgggattacaggcgcgcaccaccacgcctggctaattttttgtattttagtagagacggggtttcaccatgttggccaggatggtctcgatctcctgacctcgtgagccacctgcctcggcctcccaatgtgctgggattacaggcgtgagccactgcgcccagcccagtctttaatcttttttttttttagatggagtctcactctgtttcccagactggagtacagtggtgcgatctcggctcactgcaacctccgcctcccaggttcaagcgattctcctgcctcaacctcctgagtagctgggattacaggcatgtgtcaccatgcccagctaatttttgtatgttttggcagagacgggtttcaccatgttggccaggctggtcttgaactcctgacctcaagcaatctgcccacttgggcctcccaaagtgctgggattacaggtgtgagccaccgtgcctggttgcttttgtttactttctttacctcttcagggtgctggaaggcctggactcctacagcaggtccttgatgagtgcccactgcatggcagaccttctctgttctcttggagcttatgttccagtgggatagatgagcttggagcttagatggctaagcccacagccaaccagctatatactacattatagaatctggtctgtagctcccagttggggacgggcccacctcattctgagtaagcttcatgccagggcctgcagcccatcttggtacagggaggacagcaatggtctcccttggctttcaggccagcaggacactaaacttgacaagccttcttctgtaagctgggctgggcttctcatcaagccacatgaggatgacttcattcatttttgtctccagtatttttctgggcataaatattgaagtggttggctgggtgcattgactcatacctgtaatctcagtgctttgggaggccaaggtgggaggattgcttgagtccaggagttcaagaccagcctgggcaacatagtgagaccctgtatcaaaaaacttaaaacttagccaagcatggtggcacacacttgtagttctagttactcaggaggccaaggcaggaggatcacttgagcccaagagtcgagctatgattgtgccactgcactccagcctgggagacagagtaagaccccgtctctcttggaaaaaaaaaaaaagtccgggcgtggtggctcacacctgtagccccagcactttgggaggctgaggtgagtggatcacctgaggtcaggagttcgagaccagcctgaccaatatggtgaaaccccgtctctactaaaaatagaaaaattagctgggtgtggtggcaggcgcctgtaatcccagttacttgagaggttgaggcaggacaatcgcttgaccctgggaggtagaggttgcagtgagccgagatcgtgccactgcactccagcctgggtgacagagagactccgtctcaagcaaaaacaaaaaaaaattacggtggcaggtctgtttgtttttagcaaaagcccttcttttaactaggcattaggcagcaccagcacagtctattcttgtgtttgtttgttggtttgtttgttggtttgtttgttttgagatagggcctcattctgttgcccaggctggagtgcagtggygygatcacagctcactgcagcctcaacctcctgggctcaggtgatgtgatcctgcctcagcctcctgggtagctgggactaaagtgctgggattacgagcgtgagccaccatgcccagcctaggcacagcctcttctaaactcatagcctcaaactctcaaaaatagttgttgaatcctcagcaacggcattgccctgtcttctttgtgttctgatggcaagaccctcagaactacaagtgacctcaaagactctgcctctacctttctcctgtgactgctaatgtgttactacagaggtctggaagaagtcttaagttttcttgggccacctactcgggaggctgaggtgagaggatcacttgagcctgggaggtcaagactgcagtaagtgatgatcacgccactgcactctagtctgggcgacagagtgagacctgtctcaaaaaaaaaaaaaaaaaaaaaaagtcatgtcaaggaagatggaagagtagaaagctccaggaatccatctctccatggcaacagttgatctggttgaaaccatctgaagcaaccactttggaaatctggtctagtagaacatttccagtatccaggggagagggtgatgaagaagctggtaaacttcagtaaattttcactgttctcatagcagctccacctcctgggctcaagtggtcctcctgcctcaatctcctgagtggctgggattgactacaggcatgcaccaccacgcccaactaattttttgtagaggcagggtctcacttattgtccaggctggtcttgaactcctggcctcaagcgatcctcctgcctgggcttcccaaagtgctgggttacaggcgtgagccaccgctttgctttgctttgctttgctttgctttttctttttctttttccttttcttttcttttcttttttttgaaacagtgtcttgctctgttgcctaggctggagtacagtggtgcaatcttggctcgctgcaacctccgcttcccggttgaagagattctcctgcctcaacctccccagtagctgggattataggcacgcaccaccatgcccagctagttttttgtatttttagtagagatggggcttcaccatgttggccaggctggtctttaattcctgatctcaagtgatcttcccacctcggcctcccaaagtgctgggattataggtgtgagccaccacacccagccaccaccatttcttaatttaaaattaggaaaattaataaatctctggctggatatggtggctgtactaaaaatacaaaaattagccaggtgtggtggtacacgcctataatcccagctacttgggaggctgatgcacaagaatggcttgaatctgggaggtggaggttgcagtgagccagaatcgtgctactgtactccagcctggatgacagagcgagactgtcgcaaaaacaaaaacaaaaaaaaattaagaatttttttttttttttttgagatggagtcttgctctgtagcccaggctggagtgcagtggcacgatctcggctcacttcaagctccgcctccccggttcacgctattctcctgcctcagcctcccgagtagctgggactacaggtgcccgccaccacgcccggctaattttttgtatttttagtagagacagggtttcaccrtgttagccaggatggtctccatctcctgaccttgtgatccacccacctcggcctcccaaagtgctgggattacaggtgtgcgccaccgtgcccggccaagaagtttcttaagttttttaagaagcttcttaatttttataactttttactgcagcagtattttttattgtagtaaaatataaacaaaactcaccattgtaaccatttttaagtacatttctgtggcatcaagtacatttaattgctgtgcaaccatcaccaccatcccactccagaatgttttcatcttcccaaagtgaaattctatacccattaaacaataactcccctttcccctttctcctcagctccttcacttaccattctttctgtctctatcaatttgactactttaggagcctcatataagtggactcatacaatatttgtccttttattactggcttatttcacttagcataatgtcttcaaggtttatccatgtagcatgtattagaattttcttcctttttagggctgaatcagtaatcatatttaatttttttttgagacagggtcttgctctgttgcccaggctggagtgcagtggcacgatctcggctcactgcaacctccaccccctgggttcaagggatcctcccacctcagccttccaagtagctgagattacaggcatgtgccacaatgcccagttaatttatttaattttattttttgtagagatagagtcttaatatgttgcccaggtcagtattgaactcctggcctcaagccatcctcccacctcagcctcccaaattgttggtattacaggcgtgagctactgtgcctggcagtattcatgttttaaatttgcaagcattctttcttgctctttgagtatgtctgttttgcaaagcatcatgttcttgttttatggtctcatatttctgtttgtctcagagtcagtatttgtgcaccatggactttttcctgggctcccctcccatacctggtggtccttggctactttggaggccaacctatgtgggtagggtttgggggggatgtgcagactgctggcatcatgttgagtcttacctgaacccaggatgcagaaggctttactgttgggtccaataatattggctgccctaggtcattgtacatagtttgtttagtgtctttgagaaaagctcttctatttattggcccagggcagcagcctaactgcctagtgttctaccaatgcagattaggatggggtggagccaagctcacaatttcatcagtgttccagttttcaggcctgtttaatgcttttgcaaggccctccctttccttcatggaccccctccttgtgggttctggctgctgtgtcagtctcttgtcccctggccatgctttgtctcccagaattttttggaaatctctgggggctgatggtggttgccccttctacttgttgcagtaggattacccttcatacctgtcattttagggaggcatcagcatgtagccaccacccccaactacagagtcaatgttaggaagatctctctcatggrccccaagggcccctgaactccaggctagagacagccagggagacctttccttagggtagggtaaggccgccaggagccatgagttcatggaggagatgttgactaatcccatgccacgcaggcaatgggctgctcaaggccttagctctgttctggaaaggggagctttgagtgtcttgcctggctccctgaggcctctggcatgaagccctgtaacttgaccatgggtgggtgtcccaagggtgatagtgtcactcaggagggcctcaagccagcctcaaccagtgagggaaggactactaagccctaggttctttctccttgtaggacaaacagaaagtgggaaggaaagaaagtggacccctggcagaaagggaaataggcttcaagctcatgaaggaagaagaatatagaaacagtctaagacaaggccgggcgcggtggctcatgcctgtaataccagcactttgggaggccgaggtgggcagatcacgaggtcaggagagcgagaccatcctggctaacacggtgtaaccccatctctactaaaaatacaaaaaattagctgggcgtggtggcgggcgcctgtagccccagctactcaggaggctgaggcaggagaatggcttgaacccggaaggcggagcttgcagtgagccgagatcgcaccactgcactccagcctgggtgacagagcaagattccgtctcaaaaaaaaaaaaaagaaacagtctaagagaggaagaaatgtgtccatatgatccagatgtggatatggggagtgagggaggcaccgtgagaacctcctgagtcttgagtttagtgttgtggatgaccaggaggtgcaagtgaataagcctggcttgccttgagcttgggcaccactaggcaacgccttaggggatggctgggagtagaaagtcctgccttgagccacctggagggtaaaatttacaggacccagcgagatcctgccttcctcttgagtttacctttcctaacctgagcctcaacttgctggggttggtaaatggtggcagaatatggatactgcaaaaaagttggcatgagtggtcctggctgctgtggttcccagaggaggaagcaaagcagccagcctagagttggtttgaggtgggtttgtgcagtcttcattttaacttgcaggcggggacagaggtagagcttctagggtcctggacagggaaaggaagaaatagtccaggctgcctggattgcttagccacccaaatcaatgcaggtaggcttcctccctctgatgtgtacaccccagtggaagtgggattgtggtgcagctctgaaaagttcctgaggaaggaaagagagaaggcatctttggagctacccttgccattccccagggttctccttgtatgacaggaggtggggagccctgccaggtctgggtgggctggaagaatcctgtcggctgtagttttaatagaataaaacttcactccccacccccccccccccccccccccccccgtgttataaaagtaaaaacacactcattgagaatttggaaaatagggagttatcatagaggtacttatggttgacatgtggaatatttccttctcctttttctgcatgtgggagtggtgggggggtgccaaatcatgtaattgcactatacatggagttttgtgtgctttttaaattaaattaaatttaaacttttttttttttttttttctgagacggagtcttgctctgtcgcccaggctggagtgcagtggcgcgatctcggctcaccgcaagctctgcctcccgagttcaagcaattctcctgcctcagcctcccgagtagctgggactacagacacaagccaccacacccagctaatttttgtatttttagtaggatggggtttcaccatgttagcccgggtggtcttgatctcttgaccgcttgatccacccgccttggcctcccaaagtgctgggattacaggcgtgagccactgtgcctggccgagagtagggctytcttgaggggtggccttgagtcaggagtgggctccaggtccctggagctgagttatctctgatgcttcaggagctgttgtcctgggttaccactgtggccccaagtaaccaggtcatctctgccttcagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacagtgagtgatagtcgctggcactgtccatgggctggtagggggatagctaagacagctctgcaggccctgtgctgttagctctgagtggctgatggggcagtgagggttgcctaggcttggccatggctttggttccagctacctcttgttccctcacctgagcactcaatctgtgcaaaccccttctcttktctcattattcctcaccatcacctttcaaggcaaacgtattggaatgcaagttagagagaatgcagtgatgccagaaggggtgggtctgggctggagagggtgctcccaataccttgaaggcctgcccaccagagtcctgagcgagggactctgaacttcctcttctatgtttgcctctgaggctcatgcctgagggaggatcatctcaaaccacagagcccaaggccttaccacccaagggggtgacccacaggggcaagcatgagaagctgtctggaattccagtggggcaggtggaacctgctctggggtacrgtgggaccagaaaaagggaggctgtctccttggccaggtttgccaagtgtaattcactgtggagacaaggactatactcattcatacaggtactgttcaggtgaggctggtcaagggctgggcaggtttcctctttttcaaagactttgtacagagagaaagaagagaaagagaaagaaactgagatgctagacagtggaggtggaagggagcaagagggcaagccagctgggctgtcctacctcccaaacctcagggggcatgggcacccctgttgtagagggcgaggcctggtagcaatgagaaacaaacctaggacccrtgggctgtagtcctcagggatcctgtcagtgtctgctgtgtactctggcttcctcccattgcccytcttccgctgtaaaggttgaaggtggacacctggggtcttcaggctgccaggcctttcagagacatttccaccaccttcatggcctgtggaggtagtgaaggaggtagtgaagttctgagtccctaactcagctcgtccttcctggagccttggttgtcatgtagccttaccacaggccgttagggcaggagcagaggagtcagtcatcaggccctgatcccactcttgtccttatggcttgagaagccacagggccagccttagatcaccatcttctcacccaccagggaaaatgccaggagagggtatccagctgctgggttccccaggaattggatggaaatacagtttctggctctggggctgggattgggagaccagggcctggggccatgcgctattctgccccaggcccttcttagacacactctctagggagatggcttggccctgtgttctgagaggattttgtgggctactttactgaaaggctaacttactgaggctctcgtggaggtagtgtcccctctctgggaagacaggactaggcctgagctcattaaatttcttttgctcgtatcagggcatgactggctttcctcccgtgggtggtgagttgattgggctcttcagccccatatagagcctgggacatggtgaggtgcccgaggacttgaggagcgttggaatttggccttgagtggaagccacaggattgggacatggtccagtcatccccagtcatccctgtctctgccaccctactggctgtggctgtccagctgttaacagacctgcacttggggtgggatcactgaggtgccttgcccagaatgcaggcatggcagcagcagtgccacatggtaactccccaaggggcgtgtgctgagcctggttcacctgcccccatgtcttgcttacctaccccttgccttctctctcattcttgtagctccccaattcaggatgtccccaagaagatatgcaaaggccccaggaaggtaagagctttctagaagaagcacagtctaacctttggcaggactggacttttgggagggcacggtcttgccagagccttgtcaytcctggtccaggactgaggtacttcggagccacccttgggattctactcattatccctcctgcctcctagtgaggcatcagagatcctgatcttgttccaccaccactaccctccctcctttgctgacatccagctcatcaagtctggccctggggtcttccctgcaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtgagtgtggcttcccacagtggcaggagccagccctcttgggtagaaatgggtggccagccccccagcccattagcctggcccactcatctcttccttccaccctaggtaaggacaggcttcgatgggctcggtggccggacaaaattcatccagcctgtatccttttcctgtgatgttgagctgagctgaactgtggagcccatactatgcctcacctatacccccagcctgccagtgccaacagcctcaggtgtgcagtgctgggcctcattctgtgtatcagcgccgcccacccccggctctgagcctttcttgccctgcattgcagtcctttctcgccctgcattgcagtcctttctccatgcctcttccttgacagctcctccagactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgrcacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaaacaatctcttcttcctggttctgagagtgtaaatttgcaccaacactttagaaaactgtttggcatgactttctaaagcaggaacatcgccaagcctcagatccagcagttccttccctaggcatatgccttgctgcatggggcacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttttgcaacagggtctccctctgtctcccaggctggagtgcagtggcacaatcacagttcactgcagcctcaacctcccaggctcaggtgatcctcccacctcagcctcctgagtagctgggactgcaggtacatgccaccacgcctggctaatttttttatttttattttttgtagagacaaggtcctgctatgttgcccaggctggtctcaaactcctgagctcaagcgatcctcctgccttggcctcccaaagtgctggaattataggtgtgagccaccacgcgcagccaacggcactttcttctaaagtgcttcccttcttgacccccagcctgggtgaagtcccctaaatttccctctcccactattaggtaggagttcacctgtttttccaggacccagcatgggcctggcacggggagtaagakgcacagggagtgagtgagtgctgcagtggaggttgcccagctgatctctagcatatctggaggagtatggggctttgtggcaaggaggtgccattcttggttatgagttttggcccctctgcagctgacttgagccaaggaagtttagtgatgcaaagcgaagcatcaggttaagagtgtaggggctggctgctagcaccatccttaccagctgagtgatcttaggtaaattacctggcctctctgtgctcagcttcttttttttttttttgagacatagtctcagtctgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggtgaaaccccatctctccaaaaattcaaaaattagctgggcatggtggtgtgcacctgtagtcccagctacttgggaggctgagatgggaaggtcacatgaccctaggaggcaaaggttgcagtgagccgagatcattccactgcactccagcctgggcgacagagcaagactcccaaaaataaaaataaagtggggatctgtgttgcgtataggttaagaacttatggcagctaggtgaaataagccagacacaaaaagacaactattgtatgattccacgtacatgaggtgtctagaacaggcaagttcacagagacagaatagaagttagcatgggatagagggagggggcaggggaattattgcttgatggtcacagagtttctgtctagggtgatgcaaaagttttggaaatagataggtgtgatgattaccaaaaaatgaacttgtgacctgaatacatggatatcttgtgttcatggattggaagactttaaagatggcaataacccccaaagcattctacaattcaatacaatccctatcaaaattccaatggccttttttttttttgcagaaatttgaaaactgattctcaaatttatatggaattgcaagaggctctgaatagccaaaacattttttaaaattgttttaaagaaaagataaaagttgttcccaatttaaaaacttaactacaaagctatagtaatcaaaagagtgtggagcgaaggcatgcataatggtggaattggaagctctaggggttggttcctgaatcaaagcaaccattgagctgaaaagagcagtgattgtaatcaactgtttcagaacccggaaatttaacaagggggttgcttgatgaagagagtagtgtgaatcaagcagctacttctcccattcctcagccccatccggctgtggggatagcagcaccagttctgaaagcagctgactggtgccagaacaggcacgggaaccttgccctccaaaaatgctggggttgtgcgctttgacggacctggaggtactctgagatgcttgccttggtttcattcagcctcttagatgcaattcctgcattaataccccacccaaccccaccttggcaacatatcagaagatttaaaggactcgtgcctttttttgtttgttttttaagccagaaaatctttgtcagctcactcactggctgactacagagataatagaggcccggcacagtggctcacactgtgggaggctgaggcaggaggaatacttgaacctaggagtttgagaccagcttgagcaaaatagtgggaccctggctccacagaaaattttaaaaattagccaggtgtggtggtgcatgcctgcagactcccagctactagggagtctgaggtaggagaattgcttgattccaggagttggagactgcagtaagcagtgattacaccactgcagttcagccggggcaacagagtgagaccctgtctcataaataaataaaaaattaggttgctgcaaaataaaatattagattggtgcaaaagtaattgtggtttttaccattactttataagagataacaaacttcagtgaccacacacacacaagagacacacactttgcataaatagtttggaaaaaatcacagatggctccagccctcaacaagcaaaaatttaggtcaggcacagtggctcacacctgtaatctcagcactttgggagcccgaggcaggcagatcacctgaggtcaggagttctagaccgtctgagccaacatggtgaaaccccgtctctaccaaaaatacaaaaaattagccgggcgtggtggcacatgcctgtaatcccatctactcaggaggctgaggcaggagaatcacttgaacccgggaggcagaggttgtagtgagccgagatagcaccactgcactccagcctgggcaacagagttgccagtgtcaaaaaaaaaaaaaaaattaacaatccctgaggagtcggagaataagatttgccagagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgaaacggatttcactcttgttgtccaggctggagtgcaattggtgcaatctcagctcactgcaacctctgcctcccaggttcaagcaattctcctgcctcagcctcctgagtagctgggattacaggcatgcaccaccacgcccggctaattgttgttgttgttgagacggagtctcgctctgtcgcccaggctggagtgcagtggcgcaatctcggctcactgcaacctttgcctcccgggttcaagcaattccctgcttcagcctcccaagtagctggtattacagatgcctgccaccacacctggctaatttttgtattttttttagtagagatggggtttcgccatcttggccaggctggtcttgaactcctgacctcgtcatccacctgactcagcctcccaaagtgctgggattacaagcgtgagccactgcacctggcctaattttgtatttttagtagagatggggtttctccatgttggtcaggctggtcttgaactcccaaccttaggtaatccgcctgcctcggcctcccaaagtgctggaagtgtgagccgctgcgcctggcctaattttttttgtagttttagtagatatggagtttcaccatattgcccagactgttctcaaacttctggtctcaagggatccgccagcctcagcctctcaaagtgctaggattacaggtgttagctactatgcctggccagaatattcagttctcaaaaaaatcataaagcgtatgaagaaccagggaagtatggcccactcacaggaagaatttttttttttttgagatagagttttgctcttgttgtccaggctggagtgcaatggcacgtcctctgctcaccgcaacctctgcctcctgggttcaagcaattctcctgcctcagcctcccgagtagctgggattacaggcatgcgccactatgcccggctaattttgtatttttagtagagacagggtttctccatgttggtcaggctggtcttgaactcccaacctcaggtgatccgcccgcctcggcctcccaaagtgctgggattacaggcgtgagccaccacgcctggccacaggaagaatttttttgacaaactatccctgacaaactctggagctgaaaagtaaataggttttcagtgagccaagatcgcgccactgcactccagcctgggtgacagagcaagactctgtctccaaaaaaaaaaaaagaagaagaagaagaagaagaagaaaaaagtcatcaccaaaccacggtcacctagattttcccctatgttatcttttaggagtttgataagttttgtattttacatttaggtctatgagccattttgagttaatttttgtgaaaggtctaagatatgtctagatttttattttgatttttgcatatggatggccaattgttccaggactatttgtgaaaagactactctttattggattgcctttgctcctttgtcaaagatcagttgactatatttgtgtgggtctgtttctgggctctattctgtttcattggtctatttttgctgacaccatactatcttgattttctttccttcttttttttttttttgagatgaagtctcactctgttgcccaggctggagtgcagtggcgcaatctcagctcactgcaacctccacctcccgggttcaagcaattctcctgcctaagcctcccaagtagctgggattacaggcagcatgccaccacgcccagctaatttttgtatttttagtagaaacagggtttcaccatgttggccaggctggtctcgaactcctgacctcaggtgatttgcctgcctcagccttccaaagtgctgggattacagacatgagctgccacacctggctccccctcctttttttttctttttaaatagagaccaggtctcacgtgtagacaggttggtctcaaactcctgggttcaagtgatcctcctgcctcagccccccaaagtgttgggattacaggtgtgagccaccatgtccagtccttactgtcttgattactgtagctttatagtaagtcttgaagtcaggaagtgtcactcctctaactttgctcttcttcagtattgtgttggctattcttggtcttttgcttttccatataaactttggaattagaccgggtgcagtggttcacatctgtaatcccggcacttttagaggccgaggcaggaggatcgcctgaaccaaggagtttgaaaccagcctgggcaacatggcgaaaccc

SEQ ID NO: 10768 - DNA, 17576 bp, Homo sapiens
  misc_feature (1)...(17576): n = A,T,C or G, or insertion/deletion polymorphism (see Tables 1-2)
catctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaagatccctccagacataaagtcccacagccccaaatgcccttctactgtcacgggttgctatagtaagtccagcccggcccactggcccggcccagctgcccactgcccggctgcttggttgacgtagctgtagctcccggggtttgtggtgctgatgggtgggcaaggccaactgatacacagaccatggtttgggggtggtgctcaagaacatagctccctcttccttctggggtgctgatagggcaggaccttcttccctaggcaggaccttttctgcccacatcttctgcagtaggcatagttcagggaccaactcctttgtgtggtccttgctctcccacacaaccactgcctgctccacacaaccacagcctgctctcctacacaaccactgcccttatcttgcctgagctgcccaccattcagggaggaagggctgggcctgacctcagtgcctctggggactaactgcacggtgactcctgccccatctgataccagctggacgggggctttcccggctgctaagactgcatgtgcctgaggctgccctgggcactgcacacatgcacgtgcacatgtgggggtgagtagaggtcagcacagctgtttgtactatttaaggcagatgtggcagcagccatcccagacacgtctgttcctcagccaagctgcagtcctgatgcagatgtagccaaaagctcctgggtcctaaatatggccacagggtccactgcccgtccccattaaccctatccacccatgtgttcctccatctcaacagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacaggtgaggcccagtacccgtgaaggccagtgggaccccctccctagtgctgcttaggctctaacccaagcactccatctgtccgcagtcatgatgggctctctcctggctgccaccactgaggcccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccagaaaaaaaaaaaaaaaaaaaagcccagtgtagtggtaggggcctctaattccagctactcaggaggctgaggcacgagaatcgcttgaatccaggaggtggaggttgtagtgggccaagatcacgccactgcactgcagcccgggcgacagcgagactccatctcaaaaaaagaaaaacaatcagcgattttgtgagaaaagccgttgaggtcctctcaaatctgcatgtgagcaagtaggtctacaacaggcaaacatactgcttcccgacttctgaaaagtcaaggaatcctaagtaatctagatgaaaaagtgactccttggtttcttcacattcccctccaagagcccagtgagccatcagctcctggccagcaacacacctgatacaaaatgggagaagtgtataaattattatgttgataagcaagataagtgccaaagggtagataagagtgaaagcattgggaagcctggcagagtgcagtcagcaggtcagttcctggcggttcattgagcagcttggcccaaagatgtaagtgaagtccctcctggtggagggatgagagcagctccagttactcggccttcatgacacaggaagttgaaggtggcacaggcattgggctgcaaagaaaaggccagcatcagcctgtctagcgccaggcctgtgctccccgcagcatgccccagtcccgggactcaccgtgtcctgcacttccacagcaatgccccgctgcctcatggcttgaagcacctgggactgcagcctctcggtccggtctccagtccccaccaccacgatctctagggaagggtgggtgtggctagtctacagttctgttgagaggctgcagtgggggtcgccttctggggcccagaacacctctgttctccctccccttccccagtacctatccggggctccagcaaccagaagagggaaaagctgtcttcggtgatgtcctggtgggatcccacctgtgcagggaggaggcacatttaatacgacaaatccacgcagcctctccccatctccatccactgcaggaggagacagaggaaagccaagtttgcagggaccaagcagggtgagggcctgtgactctgggcctcagtttccacactgcgggccaggactcacgttccactgcaccaccgagtgcgggagcagagcgcaggggccgagcacgcggtttccgtttatcatgaagccgcggctgttgtagctgtcgatgtacattgcctgagcggcctcgcgttgcagcagagagatgcgcgtccgctgatacagctcgtcatccgccggcgagagccgatgccctcgccgcggggccctgcggagggaaagggtcaggggcgcggggccgggccgggcagcccgagaggccggaaggtgctgggctggcagtcgccggcctagggggctggatggtcgagggcgcggggtccaagctcaccagggaagctcaacgggcggacagcgcagcgagggtcgcgctcggtacaagctacgtagcgcgagagcggtggccatggctgaccaacgcgcggcgaagtcgtcaccggcgccgttagtccccgggttgggagggccctgcggagcctgacccagcgtggctgcagcgccccctgcgtcccggagggcaccgcacagctcgaccggcccagcaggcgagtgtcctcagtcttaggaggccgagttccccgacctccggcgcagctccagtgtcagcacctgccgccctccccgccccgggcccttgcccatagtcccgggggagtggaacacctggcagcgtggccaccctcagggcgttgcctgggccgcagccgcggcctggcccccgggctctcagctattaagccgcgctcccggggcggggcgaccgcccacctggtcgcgtcccgaacacctggccaggcggtgggtgccagacttctagcccctaattccagcctttggggcttcgggcaccgtgggcggggcagccggctcaagtttctccggctagacgcggaagcacgccccgccctaaccgtcacccgcgcgaccgttggcctctccgcagcgcgcggagaggggcgtggccgagcgtggattggcttctcgggttctctagggggcgtggccaggtggtttctccttaaaatggctccaagtctgcaggcagccagagcaagcggaagggcaagctgtgatagtgtttgggtggctgttcggctggcccagaccaggccgaaccggaccagacttgaagtagaagcgcgtggagcatcaccttgtcctcgttcactctgctcgcgtcctgggagtcccccgtcccccgtcttgatccaagtcaagggcctactggcgcgagagtcgctggcccccgcgcggggtttgggcatctcggcacgccggctctgtcgtggcctcaggggaacattgtcgctttcgctacccgcggggccgggcgagcgggaagctcggcacagtgggagcctggtggtgggtctcctggggccggtcgcaatgggtttccgggggtcccgcggctgctctgtggaccccttcggcccctggtgctccgggcgctggcagcgtcaccggacaaaggccaccgagcgcgggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggtgagcgtcttgttccctctagactccgtttcacaacctactcccgggtcttcctcctgggactggggatgggcgggttctgatgtggccccagggcgagtgacctgggggcaggagctcccccgccccccgccaacggctggacagcgggcaacggaatcccaaaagcagctgttgtctccagagcattccagctgcgcttggatttcgtcccctgctctcctgcctgagcagcgccctggcccagatggggtgcccctgacccccagacatactttactgagctgcttgggtctcagttcctctcagttgcgccctcaggctggaggtgatgggtgtagacgtgggagagccgaggctggtggccatctctggaaccctggggaggattggcgagggagggtggacccaggacctctgggtagggctgcaatggtagtgactcccccagggctgcctcagcccgcatctcgctaaagatagccctcttacttcctggggaaaaaccaccccaaccgtcttcgtggatgagagtatctgaagtcctcagtttgactgagggttcccaaccctgctaagcagttgtctccaggtcatgcaccttcagaatggaaagcgctttggaatgacacgatcactcccgttgagtgggcacccgagaagccatcgggaatgtcgtgtccgcccagtgctctttcggcgcctcccagcagggcctcagccctggcccagaaaggggccttgccaagcttttcctgcccctgggtttccctgctctccggatttcccaactctctctactgagttagcttctctattaaaaggaatgggggtggggtggggggtgagtaagttacagtgaaatgaagacatttgggaacctttgtgggagaaagaaaaagacctttcctattggtagaggagcaagatactccaactgaggcctattttctattatggtcgcattatttggttggcccgtaaatggctgttgcctaaaacaggaagctttaaggatcgttgttaaagcacaccaggttaaaggagtcacattaaaagctggtcattctgagccgggcgcggtggctcacgcctgtaatcccagcactttgggaggccgaggcaggcggatcacctgaggtcgggagttcgaggcttgacaaacatggagaaaccccgtctctattaaaaatacaaaagtagccgggcgtggtggcgcgtgcctgtaatcccagctacttgggagactgaggcaggataatcacttgaacccgggagggggaggttgcggtgagccaagatcacaccactgtactccagcctgggcaacaggagcgaaactccgtctcaaaaaaaaaaaaaaaaagtctggtaattctggaagccatcatgatggttgtgatttctcaggtatcaagagaagaaaaccgccaactgtatcagagtgcttatttattgggcataaagaccacccgggctgggtgcagtggctgatgcctgtaatcccagcactttcggaggccgaggcgggcaggtcacgaggtcaggagttcgagaccagcctggccaacatggcgaaaccccgtctctactaaaaatacaaaaattagccgggcgtggtggcgggcgcccgtaatcccagctactcgggaggctgaggaggagaatcctgtgaatccgggaggtggaggctgcagtgagccgagatcgtgccactgcactccagcctgggagacaagagcaagactccgtctcaaacaaacaaaaaaacacccatatctcaaacgagaaaatgcttgcaaataacctgaaaccgcggaacactattctttttaaaacgagatattttaagtaggtcgtgaaagtggccttaatgttatactgccttattccagtgacgaatattcatcatgtgtaaaatgggagaaatgaaatgttattaaaacaaacatgtgagacttcgatgagaagagacggtacccggtctaagcgcccaccgggtcgcgaggatccttttcctggttaaggcctgggtcacagcgaaagaaccctaggcccagggagggccccgagatttcagatccggggcccggctgtgcaggtggaccacgcggaaggggcgctgggggcggtaggtcgaaagcagccgacagggctaccactggcgcacctgtccacttacggggaccaccgccgcatccccgccccagctagtcggtcctttccggaagttccacctccctaaatttttttccggttccgcttactccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggtgggcgtgagccgggcggggccgtgcggccgggagatgggcccmgtgccgtggctcttttacacgcccgttctcccgcaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacgggtgagcggggccgcggggccggaatggagaaagtgggactgccgggtacctagaaagcgagcggcgccgcccgtggggactgcggctggaggtgggaagtcgtggcgagctggaccaggtgctcagactgaggcggccgccctcccttcgcagggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctrtgaccccaacctggacaactgtctgggtaggacctgaagcctagcagggccagaaaaggcaggagggggttaggggcacatctctrcttcttgtcagtctcagcacctgtctgttctcttttcagtgactgaggatctcctctctgtgctggctgagctgcaagaggctctatggcattggcccgaggacagccacccaggcctggttagtgactcccagccctgtaggttctcccaaaccaagtatactgtacttccacagttatgattgtcctcccttaggctggggcctcagatactggtacaggcggctgcctggttgtacatgttgttagctgtgaggaggagttccagcaacagaagttggacctgctttggcrgaagttggttgacaaggctccactcagacaggtaggttaataatgatggtggagctccccaccacctaacccccaacctcagagggcccttgaaaacccaccgaggggcttgttagctgacagaaaccaacacttgaccttgggggagttgctggacttgagagggcatgtacagcaggtgcagaggctctggggaaggggggtctgtagacacatcccaagaacactgaagaccaggttgagaaggatgaaccatgcgtagcctgagtggctgggtagacggaggcactcaacctggcakttccaatttgagggagtctgggctgagtagaggcaccagatttgggctcctcaagggacttcctggagagtagcrccaactaggctgagcccctgacatctttctgacagaagcacctcatctgtggccctgtgaaagtagctggtgcacctggcactctgatgactgcccctgagtactacgagtgagtgaggctgggaggaacaccaacctaagccagggtaatgaggggggactctttacccaggaccctgcccactggccttcctctcttccaaacacaggttccggcatacccaggtgtgcaaggcctcagcactgaagcatggtggggatctggcacaaggtgtgcctgggaaaccctggctatgttctgggttaggggcaggttttttgcatccctgcccttgcctgcagactgactgaccaaccctatactccctcagacccagcctggacagagatctttggtgttctctctgtggccaccatcaagtttgagatgctgagcacagccccacagagtcaggtgagcctgggagcctgacagggccagtgttggggcacagggtgtggtggctgccttctctctctgcagctgtgcttctattccccagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgaggtgagtgtccctcctggtagctggcacaaggaggcctggacttcccctcccagcacctttctccccaacagggtgagtggttgttgctcttcaacagtatcctcccctttccggatctgctgagccggacagcagtgctggactgcacagccccggggctccacattgctgtacgcacagagatggtgaggcatagacaaccaggacactctacactctattctttattctggcctggggcacaagagcaaasagatgggccagtgactcagtctctgtctctagatatgcaagttcctggtacagctcagcatggatttcagctcctactacaaccgggtacacatcctgggggtgascacayagcaaaayggggtgggacgtgcagagaggtatagggtaaaggcaaaggaagcagaggatgagaccagcaggccctttctctttcaggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaagttctgtcttgtcatggggagtcgggcatattcttggcagcactccactcaccttcagctcctgcaccgacatcaggaacccacggccaccacctcctcccctcaaggcatgctgagcatgggcacagacagcccatccctgctccatgctgtctgtgagcaggccccatgcccagcacgccagccaccgcaggatacctcagtcataccagttgtaaacctcaagcccctgacccccaagggcacaacggtggccaaactcagggctcacaggccagcagtccatgtcagccacatcaggcacatggaacacagtgctattcatgaaggtgggttcaccatgccccagacgccagaaggtcagccgttgatcaatggaggctgagaccatgatgcttgggcttaggatcttgaggcctgtcacatgggcagcatgtgcacaggggacagagtattcctctagcacacgcagctggggtaccagcccagcctctcccacagcctcttctagctgtagcatctccacagcaagcacgaagacatggagggatccatcttcactgccactggccacgagatggtggccctcacgggtgggcaaggtgtgcaggctgttgataccacagctgtgggcctggagagtcagggagggggtgccaagccctgaaggaagaggaagagggtagttgtcagggccccgcctgccacatgtgtgagggctatgtgacaggtgaggaggggtagccatggttgcacattagctactcacggtagggaagcccaggatccactggaggctccaggacagtggagtcatggtctagcatggtggtgagatcccagaaagccaggctgccatcagtagctgcgctgcacaggaggagcctcctgagagccaggaaaagacagcctggtcaataacagagatgaagctcaacaggaaccccccaacccagcccatgcaggaccatcatccagcccctctcaccgcctctggttgggtgcctcgtgtgtaaaggagtggaccttgaggacacatcgcttatggtggaaggtttcagcaaggagctgcagaatccgcccagaatcctgcaaaagaaagagcctggggggcggggggtggcccagctcagaacgcatcctagacaaccttacttcctttgtctcctgtcccactgggccctatgctctcaccttacggccccatcactacaggctgcagccacaagggggccaaggccgggctggtcaagttcacacacagcaagggacatgtacctgcagagacaacatgcagctgtcaggtggagcctgcaagcctgggagcatctgcatgacccataccacaccctgcccaggagcatatattacctggtctctgggtctaccttaaccatccgatgccgattgcgttgccggtcccaatactcatctagccggtgggacgaaaggtgcatgacatggcaggcgaggcggcttggggtgctggggtccggagtaaccatgatgctgaagcagtgcatctcagcccgcccccccgcagacaccacatgggcagtcaggcctggctgaggatcctgagggccacctggggtgccaatgccccacacagccacagcacgtaccgaggagatatggttacaaacagctgtgagtgcgtgggctgagcctgtggttgtagggagtgctaggacacagacagtagtgtcctcactacatgtgatcacaatgtcagtcaagtcgggcccctcactgccaggctccaggtcatcaggctgcatgaagctgggcactccatattcaggccccagggtaatggtgcccacacgctttacacaagtgatctcacggccatgcagaccctcccggagaatcacgtgtggccgggtgcagccacccagagccctgtacagcatgacatccccatccttgaggtaagcaaaggccatggccgcctcagtatcagagaatgcccacgaacggtgccctccaccacagttgacgatgtgcagcttctcgtgtgaccgagggttccacaccacaaactcattggcatggaaacccaggataaccatgctcccatcgggcactatacggagcccagctagccagttcatgcctcgacaggacttctgccttaggactggctggagctggccgtctcgtacaaacagctggtagtaggctccatcacgccctgtggtatacacatagccaccatggcatgtgactgaggtcacaccctgcttcccgtgcagagagggcagggtagacactgggcccaacccagtgaaagcattcccacccccactactaccactacccactacaggtgccccagcaccagcccgagccttgcctcccaccccagggtccttgagcagacctggtctggaggggaatagcagcacagagccccggcggtcaccacacaccaggaagtcacctgggggtaggaaggcactgcatgtgtgccatctctgcttgcttgggggcagcaggtaccgacaacgttccttgacaaagatggccttgccagagggtgcggctgagatctctaggcaagctactaccccgccagggcccgatgccagcaacaggagctcctcataaccacgcagggcccagctcaagctgtgcaccttcccaggaaacagggtctggtccacagcagcagttggagtgttgatggggacaaccttgacacgaccttccccattggccatagcacacaatccgaagccctcgggaccaggagctgcctccagcaggcagtaggactggaaatgtttatcctctagcagctgctcccagcacttgacctcgacgtcatagagatacagggcccctgtatcagtcactgccagcagtcgccaagagccagccagagtcacagccttgagtgtacctggcctactacgggacttgaagcagagagccgagacccccaatccccggtacccacgccctaccaagtgccacagccgaatgcctgagtcatcacccccagtgatcacccaggcctgcctctcatgggcagctatggcccggatcccacgtccctggtgtccccgaaaggcctggaggatctcaccttcatggctccacaccaagcagacacaatcctctcctgcactgataaggtaattctctagaagcttgacctgccacacacgggcgctgtgcccaaagcagtgcccaatattctgcacccgacccccaggcactcgcaggtcgcccaccttccagatacgaacgcttcggtcttctgaagctgtagccagcaatcccttgctttccaggtatgacatgctgaagatgatgcccacatgcccactgattcgtcggtcaggtgctacaggtttgttgtctgctaaggcagttgctgggtaccagaccaagagctggttggaaacagcacctgccactatggtcagctccttccaggcgtctccaatcaggcaggctgaagagagggtgcacctgtctgtgcagggcacctcttgcaggatgcaccctactacagggtcatatagcaccactgagttgtggcccagggccaaggctatatttccctcaagccagcgtgcatcccaaatccagtcagacatgttccacaggccagagcgccaaagctcccagaagtggccctgtccccagctaattttcacaactcggagtcccttgcttccaaacacagccaccatggcctccaagtcaaggtctccattaggctctggccgtacccggaagccatggataagatagtggccaagcaggttctgcactcgctttatcatccgcagatgcccaccaaagtccaagctgtacaccaggacatcgggaccctcacctagatagaggcaaagagccatgtcagagctaggtacctaactctgatgacccacagggaagagatggggatcagggaaacttctcggcatgtagcctatgaatgcatcaggacacacaatcctgcagcttgaatcttagaaaatccttggtctcggccgggtgcggtggctcacgcctgtaatctgggcactttggaaagccaaagccagactctgtctcaaaagaaaaaaaaaaaaaagaaaatccttggtctcggccaggcacggtggctcacgcctgtaatcctagcactttgggaagcccaggcggatgaatcacctgaggtcaggggttcaggactagcctggccaacaaggtgaaaaccccatctctactaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 10769 - DNA, 26266 bp, Homo sapiens
  misc_feature (1)...(26266): n = A,T,C or G, or insertion/deletion polymorphism (see Tables 1-2)
agaggcacgggggccatgggaggggcacgcccacaaggggtttgcaaagatctttctaaaagaaaaggagttcaagtcatggacagacatggttagagaattcagtgatgccaagttgtcaggcctgagagccccagggaccctctcctactggaaggccagagctgcagaaagaggtcccctgggctgggcgaatttctccaaataaattcaaacatggcctgcctcgggacgggggcgagaccctgggccctcaggggcactgaggggtcgtccatgccgggggacatggccacttgggggcggccctcgtcaaccgcggagtggggaaaaggggggagggatggaggacgaacgcccggcggtgtctaaaggcacgacgcggagcaggaaccacagccctggtccccagaaagcgcgcgcggcccggggcagaacctgccgaagttccagctcggggcgcaagggatgtgggggtcactggaagacggggcgcgggccgcccgtggggaggagactggacccgaacccggcccaccccacccgagcggcgacgccagcgctgaccccaggcgtgtcccggcccccggcgcggctccggcccaaccgtgcacgcccgcggaaggcctcgcacccgcgtcagaagtggcctgcccggggccaccggcccgcaagtccccggtgttctcgaggtccctgccccgtcccgcgcggctgtagccggcgggaggggctgagaggcgggtcgcgctgggacctaaggcgccgccccctcgccagcctctccctccctccgtcacagggtggccggagacccgggggcactgctggggtaccccaaagcatagggccagcctgagtgcgcaaggtcctgaaaagacggggaggcggcgacaaggagtagggaggggggctggaggaagacggcaaagtgaccccggaagggtccaggcgccccaagcccatcgaagacgggaggctctcagtggcgcctggggggactgtgggaaaagcagctcaagaaggggaatctggagcgaggtgggggagaggtcggcatggccttctctaggagcgccagcgccagacagagcggtgacaggccgcaccgggagtaccccgtctatactgaacgggtcaggagtgtgggatcccgtggaggggctgcccttgcagcaggagcgatggccctctcgctcccctccacctgctgccatcgaaaaccttctggaagaggccaggcgcggtggctcacacctgtagtcccagcactgggaggccgaggtgggcggatcacgaggtcaggagttcgagaccagcctggccaacagagtgaaaccccatctgtactaaaaattaaaaaaattagttgggcgtggcggcaggtgcctgtagtcccagctagtcgggaggctgaggcaagagaattgcttgagcctcggaggcggaggttgcagtgagctgacatggcgccactgcactccaatcttggtgcctcaacaaaacaaaacaaaacaaagaaaaccttctggaagaattatcctcctttgaggatctaacccttcttgctcccaatgcttcccagcagggcccgcaccccaggacgggtacttaccgcagtcccccacctccagctctgcacactcgcagcccagtgcccgctcttccccctcagcctcccgacgagactcagctcttcgacctccctgcgagtccctgtgcacccactttgttctgtgcctgtccctgccctgactatgtgggctcaggtagttttgtggggtgtgtggatgttgcgtgggagtgtatgtgtgccccgtgtgtcccatgtgttataaccctgatgctctggagcagaaggcgtggggtcatctgtggataaaggctggtattgaagcagggtcccccacctgtgttaggccaccacatactcttgcgtaaaagtagggtgaggtaaaccccatggccaaagcttggccaaccagagcactgtagcaccctggtcagggatggacatgtgacccacgctggcggacgaaatgcacactggggtcatctggaagcaggagccttggggaggggggaatcctgagcagatcaaagcttgatctcagtatctgacccctggatccaggctggcctaatgctgggttataaaacggcttaagccagttgattgtggttttcgtcaattgtatccaagagtagtgacccatgacgtataccccatgcctgctccaggttttcttttctttttttttttcgagacagagtcttgctctgttgcccaggctggggtacagtggcttgatctctgctcactgcaacctccacctctcggattcaagcaattcttgtgcctcagcctcccaagtagctgggattacaggcgcccaccaccatatctggctaatttttgtatttttagtagagacggggtttcaccatgttggccaggctggtcttgaactcttggcctcaagtgatccacccacctcagcctcccaaagtactgggattacaggcgtgagccaccacacccgacctgctctagggttcctgatggcagtgatggtcacaatacaggccagaaacagtcacaatacaagccagaaacctgggagtcagctatgaccatatgctccccctcaagccaccagcagttcctgttgattgtactttctggcaatagcaacagtaataatacacacgtagcacatcttttatgctaggaaacattctaaatattttaatttttagagacaaggtctcactttggtccccagtctggagtgccgtggtatgatcatggatcacggcaaccatgatcttcttgggctcaagcgatcctcccgcctcggcctcctaaagtgctgggattagaggcgtgagccacctcacccagcttgaatatttttctgcatttaactcacctgttcccttgaggtgagaccatgtgattaattctggccaaggacctgagccagaagagccatatatcacctatacgccaagcatttatttatttgccagtgctaaagcttctagagctctctttctctttgccaagaaagcctttgatttccacatggttatgcctgtagccagggcaggaactacaatgagcagagaccccaggggacccttgaagggtatacagctttgagtatacttttattagatcagagaaatttggggttgttagagcagcataatccagcctatcctgactgattatccccacaggcatagaagggactaagttgctgttaaccgacggaagcagaattgtgaacccagaagggccattccctaggacatcttgacctcagtgatgtacattctccaaagactgtcctgaatctatctacttctcctaactccattccctacccctctgaccctccattccagactttctcctggatggttatgtcagggaggaaaagcttttcctctgccctcttagattcagcatctggggcctgcaaattaaactgacaaaagacaaattagcaagagaaacggagttgtatagctttctgttttttgtttgagatggagtcagtattgcacaggctggtcaggaactcttatggtcagaggatcctcccacctctgcctctcaagtacctgggactacaggctcacgccaccaccccgatagacatttttattcgtgtactaggaggttagaattgagagctcgtaaaccaacaaaaggttgggggaaagggcacttggggaaaacaaaggacttctaggaaagataatatgctagttttgtgacagtgtctgtttgcctgtggtgccatgtctggggatgagtcccttgtgctcccagggagggggcttatctctgtttcctcttattctctccagcccctttccatgcctgcccaaaaggttatattttattttattttgagaaaaggtctcactctgtggcccaggctgaagtgcagtggcaattagagctcactgtaacccaggagtcaagtgatcctcccgcctcaccccctgagcagctaggactacaggtacatgccaacatgcctggcttttattattgttttttttttaatttctcacagagaggagggtctcgctgtgttaaccacgctggtctgaagctcctggctttgtgtggcaaatgctcattttaaaatacaaatacaacctcagcctccactcctcttcttgttttagactttatgcacagcttcaaaggtcaaaacccaaattcaattcccaacactgtgtactaggtcctgcaagctgtgctctgccctgcccaggtctgccccagggccagctttcctggtactcatgaaccacctcccgctacccaggcggcccctacaggcacggttaattttcccattacaagttgtcagagtcccatggactctgataaggtggctgtggatgggactatagtaagacagtgaggaggtcaatgtcagtgcacatgtgtttgtatcattagtgacatgtgtgtttggtacatggtgaatatacagaacatttgctatgaatgaaacacccagctgccaggtgaggtgaggctttagggcagggcttccaaacttttactgtgccagggacacccttggcatctgcagaagatgaaggacccctggttagaaacatgcttttttctttttcttttcttttttttttggggggggggggaccatgttttgaatgcattacattaccaaaaaaattaatattgaaatgcaaaagtcaaaatataaaaacacggccatttgctcttttcctagactagctatggctgggcctggtcaagctttgggaggctgaggctgtggagttccaaccctcaaccttggaagagctgtcttggaggcaggcaggtccagagccccacgtgccatgggacctaaaccgagagcaagcctgggcctgggcactggagaacttccctgtgctgagccgccactcctgccaatgccatcagctctacgggagcactgctgcgagctggctgctgcactgcacctctactgggcacggagcccttcccggatatgagaggggccaaaaatggcctcgacacttccatgtccagaagtcaatggctgaaaccatagacgggctccagtcacctcaagaagacgcagatgctaccgatggtgaggtccaaagcggcctgaagcagcctggagatgccagcgcctgcggaggtggaagtacacacgcccagggcgccttctgcagtccaggcggcctccggaagctgctgaaaacctaggattccatcaggaaggaaccgctgaaaacctaggattccatcaggaaggaacccgaaaaggagaggaaccccagcctttctgcaggcctgcagtacgacccgcttcaactgctgccctggaaggagcccgaggcacccagtgggggccctcatgccgtgcctgcggacatttgcactggaactgtgccctgcatgcataacagccttgaggtctgtgcggtggagatcattccttaatctgttctttctctcctgagcgtcctaaacatttttcatttagaaaaactttcttcatggaggggtgggcgcggtggctcacgcctgtaatcccagcactttgggaggccgaggcgggcggatcatgaagtcaggagatcgagaccatcctggctaacacggtgaaaccccgtctctactaaaaatacaaaaaatcagccgggcgtggtggcgggcgcctgtagtcccagctactcaggaggctgaggcaggagaatggtgtgaacccgggaggtggagcttgcagtgagccgagatggcgccactgcactccagcctgggcgacagagaaccgccgttcgcccatccgtccagaagtaaggaaaaggccatggagaccaagggggtggggtcacggtttcccctcccctccccctcagaagtccgaagataaataggcttagaaagagaggaaaaaaatttcttggtttgcatctcactcaccctttctcaagccccatgttgcacgccaaactgttgtaggactttctccttagttcagctaaaagccaggttcttgtgcagcggccatgagagattaatctcgcagacactttgaagagtgagaaaaatggaatttattgggcaagaaggaaaaaaagggaaacagggactctcagcaaagcgagagagagtcccgctagctggtttctcgcctcccagatagaatcccaagttccaccccgaacatgagaccaagctcctcccccctgcatagctcctccccctgcatagctcctccccctgcatgctcctccccctgcatagctcctccccctgcatagctcctccccctgcaaagctcctcccccctgcagagcttctgtggctctacccagttcttccagtgcttaggcaggtgtgggagtttctcctggacctctttttttttttgagacggagtctcgctctgtcgcccaggctggagtgcagtggtgcgatctcggctcactgaaagctccgcctcacaggttgaagctattctcctgcctcagcctcccgagtagctgggactacaggtgcccgccaccactcccggctaatttttagtagagacggggtttcaccgtgttagctaagatggyctcggtctcctgacctcgtgatccgcccgtctcggcctcccaaagcgggacccctttagacttggctgtctcacttggattacaggcgtaggccacagtgcccaactgagtcactttttttttttccttaaaaaaattgttggccygcagacacatgaaaaaatgctcagcatcactggccatcagagaaatgcaaatcaaaaccacattgagatagcatctcacaccagttagaatgccaatcattaaaaacccaggaaacaacaggtgctggagaggatgtggagaaataggaatgcttttacactgttggtgggactgtaaactagttcaaccattgtggaagtcagtgtagcgattcctcagggatctagaactagaaatgccatttgacccagcaatcccattactgggtatatacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaagaatgagttcatgtcctttgtagggacacggatgaagctggaaaccattctgagcaaactatcacaaggacagaaaaccaaacaccgcatgttctcactcataggtgggaattgaacaatgagaacacttggacacagggtggggaacgtcacacactggggcctgtcgtggggtgggggaagaggggagggatagcattaggagatatatctaatgtaaatgatgagttaatgggtgcagcataccaaccgggcacatgtatacatatgtaacaaacctgcaaattgtgcacatgtaccctagaacttaaagtaaaataaaaaattaaaaaataaaaatttaaatttaaattaaaaaaaaattgttggcccggtgcgttggctcacgcctgtaatcccagcactctgaggggccaaagtgagcagatcacctgaggtcaggagttggagaccagcctggacaacatggtgaaaccccatctctactaaaaatacaaaaattaggctgggcgccgccggtggctcacacctgtaatcccagcactttgggaggctgaggcaggtggatcacctgaggtcaggagttcgaaaccagcctgaccaacatggtgaaaccccatctctactaaaaatataaaaattagccgggtgtggtagcacacgcctgtaatctcagctactcaggtggctgaggcaggagaatcgcttgaacccgggaagcggaggttgcagtgagcccagatcactcaactgcactccagcctgggccagggagcaagactccgtttcaaaaaaaaaaaaaaaaaaaaaaaagggccaggcgcagtggctcatgcctgtaatcccagcactttgggaggctgaagcaggtggatcacgaggtcaggagtttgagaccagcctgaccaacatggtgacaccctatctctactaaaaatacaaaaaaattagccgggcttggtgccgtgcacctgtaatcccagctactcaggaggatgaggcagcagaattgcttgtatccaggaggtggaagttgcagtaagccgagattctgccatcgcactccagcctgggcgacatagcgagactctgtctcaaaaaaaaaaaaaaaaaaaaaaaaaaaaattagccaggcgtggtggcgggcgcctataatcccagctactcgggaggctgaggcaggagaatcgcttgaacctgggaggctgaggttgcagtgagccgagatggtgccactgcactccaacctgggcgacagaccgagactccgtyttaaaaaaaaaaaaaaaaaaaaaggccggggtggtgactcacgcctgtaatcccagcattttgggaggccgaggcaggtagatcacgaggtcaggagatcgagaccatcctggctaacacggtgaaaccccgtctctaataaaaatacaaaaaatcagccgagcgtggtggtgggtgcctgtagtcccagctactcgggaggctgaggcaggagaatggggtgaaggtgggaggcggagcttgcagtgagcccagatagtgccactgcactccagcctgggcgacagagcaagactccgtctcaaaaaaaaaaataagataaactaaaaataaataaataaataaataaaattacaaaaaaatccaaaaaaatttgttttaaaatttttaatgagatgaggtgtcactatgttgcccaggctggtcttgaactgatgagctcaaatgatcctcctgccttagcctctcagagtgctgggattacaggcatgagccaccacacccggctaattttttgtattttttagtagagacggggtttcaccgtgttagccaggatggtctcgatctcctgacctcgtgattcgcctgcctcggcctcacaaagtgctgggattacaggcatgagccaccgcgcccggcctctgggtgactaagttttaacattaagtaactcattaacaatttctaaggccctttatgtcacaacctaagtgaaaagccattatcctttgccacaaatagaagacacctgtgaaaacacgacagtttcctctagaaggctcctataagtcccagtctctagttcggaaagttccaggagcactgagtggggagccctctcctttaacagggggcctcaggatccagcccacttcaacctctggctcggccacccccttcttggcatcaatctctctgtccagacccctcgaagctcccgattccactcagccccaggtgtgggccggggctgaactaggaagacaaagccgcattcaatctcagtctgagtccagcccctcgggcctcccccgggcgggtggggcagaggtccctgcagcctccaccaggaaccgggcccctaggtctgggaggtccaagccggcagcgggccaggcgctgcccaaagcctgcccagaggcggcgctgggccagtccctttataatttgcgcccttcctggttccacagaggattgaggaacgcctgaaattagaacgcaaatgggccgtgcgtggtggctcacgcctgtaatcccagcactttgtgaggccgaggcgggcggatcacaaggtcaggagttcgagaccagcctggccaatacggtgaaacctcgtgtctactaaaaatacaaaaattagccaggtgtggtggcggccgcctgtagtcccagctactcgggaggctggggcaggggaatcgcttgaacccgggaggcggagggtgcagtgagccgagattgcgccactgcactgcagcctgggcaacagagcgagactccgtctcaaaaacaaacaaacaaaaaacaacaaaaaacaacaacaacaaaaaaacaatgaaggcgtgggcccccatcaatatcgggctgggctgggcggggcgaggtggcccctacaccaccgggggcagggcccgttgctcccgttagcggcgckctcgggccgcccctgccccgggaagccggtacggttctgggctggtcactgctctgcatccacgagcatcggccctgataccgcctagaaaggcccatcgttcccgcctcccgggcccctgcgcgcctccgtccagaggcccagaggaagctcctgagcggggaagcgccctgggcggcagcgaaggcagcggtcgctcccggcttcaaccgcccagtcccccgcgccacccagagcccctcacgcccgggaaagagccccgagaacgtgcgaatggggtcggggtccgcgcgcggaggagatgttgctgagaagggtaccggggtcccggagcgccgcccccgccgcccgccccccgccccggctgcggtcgacctgcactcccactccagccttacctgaggccgactcgcacgagcccacgcggggctgcgggagccgatcgggatcccggccgccggcccccaccccaccccctcgcggcgccggcgacggcggtgctgcggcccctttaaatccgggccgccccgccctgcgccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggtgagcgcgacccccgcccggcccgcacctggcgcacctgggcgtcggcggcgggagcgggcccggcggtggccgcggaaggcggccggaagccgacgcaggcgccccttccccgcccgggcggcgcgaggacgcccctcccaccctcccccacttgtttgctgctggagccgcggcgttctcctcgggcccgggccgcgcccgtgggtgctccggaccggactccgcgggcgcagctgtcccgacgctgagctggggacccgtggggttctcggagaggggcagagacccaaggtcacagaggtcccggaacgccagccacagccacctgggcaggagctggggcggcgtgagggacacaggcgcgagggcacccccccaccctgctgcctgctgccccgcgccggcctgggcgaccccggcgtgacacccggtcctgggactcccttcggcgcccagaacgcgtcggcagcatccggcctgtgggagggagggagggagggagggaggcgtcctgaggcagcccggcccctgctgccctgcgctcccgtgcggccccagcccgtcctccgcaccccgagcttcccgggctggcccccgccctccgcgtgcgcccagcgctcttgcaggcggagggtgcgggccgatccccccgcgccgccccgctggccggtcttggcgatggtggggccgagtagggcctgagccctcggaggcgctcttcccccggcctggaggttccgggagagtggcctcctgcctgcctgcctgctggaggcctaagcgggctgagtccagctgcccctcggcctccccgccacctgcttccctgtttccctgtcccggagcgccatcccagagaggctgcggaggagggcgagggaacctggacccttccggaccctccgagctccatctacccacgccgagctctgccagcacgcccgcctgccgcacttgttctgccagagcagaggcctgggctggccttggggctccagggccagagaggcatcacccagggactctgcggggagcctgcctgacacgggagggatggctgggcagaggccgtgctggcggggtatattatcaagggcaggcatggctggggcagaattctctgtaggtagggtgtgtcacctggggaaggacattctgggtccttggcagggtgactataaaagcacactggcatgaaggcctaggtggggccatatctgaagggctggggcatgctctttgagtcgtgggtagagccgtgagcccttgccctttgtcctgagccagtgtgtgcctcccgcagcagccacatgcccgcggattgatgtcaggagccacctctgcaagcctggcttaccacagggagccaggctccaggacagcagagtgagggagaggcactggctccatggcacccactgtgtctggggggcatccaggaggctggctctctgagggcctggggaacaggagagcaaagaaggggagcacttagattcacgagcccagcccctaggggatagaagcctaaggatcctgtgaggtatgagtatggggtgacataggcctcccttgtcgaggggctgtcactgtttctgtggtgacccagtagtaccaggtctttggaggcctcaagagaagctgggaatctgggctcttatgtgaacccatctcgttgtcacatgtagaaaatctgtcttaaacccctggtgaaaccagacgtagccagtcggaggccagattggaacctggcctccactttgcagccagcgggggtccaggaacttgagggaaggacccagkaagtggaatctgcagggaaggaaggaggtgggcagggaaccagagaggaagggcagcaggtgtgggcatcatcctggaaacgcaaggtcaagcccaggacggcctcttagaccaacgcaaaatggaccctggagaagggtttggggcccaatttcctatctagcccgtgcagcagctctgccagcgctcaaactgtggccctcggtcaagcacctgctgaggatctgcccagggaggcagacccttgggggcagcccggggtctcagccatgcagcgctcccagccttcargctgtccgcctccccaggcctggacttcagcaatgatggacacccttactcctaggaggttgcagggtctggagaggaggcagacacctgccacacacatgcatggtgacagcagaccgttaacgggcctgatatctgcctmtgcccctctgagcctgtcccttttccctgagtacaaggcacaaaggttgtgccccagcttggctctttaatctttccccaaccaagagggaagcagggggaactgtggtttgtgggccccaggatgtcctaatgactcgcctccaggggagggtgacacagcctccaggcctcattgctgctgctcttaacaacgtggtcctgaggcaagaaagtgtggcaggggctcccaggctggtccctctcctcacctgagctgcctccccagctcccgagggttatagggtgccagcatggcttggcagagccctggcatagggcctggcccatggggaggcagtcacagagttggacccacagtcagagaagctgagggcaaggcgggtggaggagctggcaggcgggggaggctgcccagggccagggcctgcagtgtgtagggaaatgacagaagggttggtgtgggcgggagcccgtggggccctttatctcctggtaaacaggacccgggggagaggggaggcccctaggaaggaagcgagggtaaggcgcaggctgttgccagggtgattcaggcagcatcacccaccactgcccacccagcctgtccatctgaggcagtcgtgtgggacagagaaagccagggtggggctcgggggtgggggtgggcagtggctgtaagtaggcaagcggggactggcatctaggcaggagggaggcgcacctgcaggtgcaggtggctctgaacccattcctgatggctctctaggcctctgcacctccagtcccatccctgtgggcgagtgctgcctacacctggtgtcacccagcaatgggtgagccctggggatagccagctctgcattcaaggggttaggtttccagggtaaccgagcccctgagcccagcgtggagcctggcagagccngtaatctgactcccctttccctcccgccasgggctgtccagaggctccgctttgcctcagcctttagccccagagaggcagggtgtggagggtgggggctggcttcttgggtaagagatgcctcagggaagatctacctggctccctgctccttaaacctttccctcctgcccaggtccaccccttcctcttccctggtcacttggcacttcgacctcctgcccgtttcggaaaggggtgtgccctgaggtgactgaactttgcctgatcatgaccttgatcatgcacagggctgctggtggggtgaggccatcccacgcaactctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccsagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtscttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacaggtgaggtctggggcgggagggggaaaaggcgggggcgggctggttgtaggttccctggtctcagtcccgatccttcccgacccacccagaggacccccgattgaagccgtggaacggctcacaccggcacgtgctgcacctgcccaccgtcttccatcacntgccacacctgctggccaaggagagcagtctgcagcccgcggtgcgcgtgggccagggccgcaccggaggtatgggcgcagacagggaggagcacggggtggggggacgggtggcccccgcaccctttccagcgtcgggcctccgtcccccatagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgaggcgagtgagccgggacgcggggttgggggacattcagaggagcccccgcggtgcagaactgacagcaggaaccattccgaggagaaagctgtcggaagttcagttgctagtttcattcgcaaatgctccgagatagaaagttgaaagggctttctggcaccctctacccctacccatcgcccccgccaccccctagtccttggccatgcgagtcccaaagggaaagggccgtctctgggggcccccttactccgccctcagcacagcaggctcactccctccacgtggggggcatctgaagcctgtgccccttctccaagcccttccaggccttttggggcagcagcagggctaagggagggtgcttggtctccccacagactgactcacagtacacttcggcagtgacagagaacatcaaggccttgtgagtactggcgaccccagagagctggtggcgggagagctyggtgcggggtgttgtgctggcaggttcctgcctccccatgagatagtgcctttcctatctcgtggggaggcagggacctggtgggggaggggtgggtgtgcagaagtggcccagcccctctggagctctgctacctcagttggctgggtgtagggggtggtggggggctggcactgggtgagcctcaagaaagggccacagtctggtgggctcggcccctctcancccctggaggctgcatacggactaggccttcccgtcccccaggttccccacggagatccattctgggctcctggaggtcatctcaccctccccccacttctaccctgacttctcccgcctccgagagtcctttggggaccccaaggagagagtcaggtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacaggtggaggaccaaacagaacctcgattactgcttcctcatgatgtacgcgcagtccaaaggcatctactacgtgcaggtcagccccaagccctgcgttgccctgccctgccctgcgccgccctgccctgcgatgggtctggtccatctgggtgcccttcctcagccccagcccctctctgctcacctcgcagctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaacccngagaaggatgcggtgagcaagagctggcgggactggcaggggcagggccaaggggcaggcagcctccaccccaaactgtgtccctgtccttgcatctgctcacatagagcactgtcagctgtgggagggccctggtagtccccaggagaggccgtgttgaggaaggagggctaagccgagccctggggtgttgcccaccctccacagaagcactgtgaccggcagaaagccaacctgcggatccgcttcaaaccgtccctcttccagcacgtgggcactcactcctcgctggctggcaagatccagaaactgaaggtgggctgcactgcacgctctccctaggccgggatcaaggtcggggcccacgccatcactgctgtccctcctccgctgcaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacgtaagttcggtgggtgtggtgtgcactgaagccgggcctcctgtgaccacctgcctcagcccttgattctgcccccagaaccctcagtcagacaaggaggccctgcaggagggccgcaccgccaccctccggtaccctcggagccccgacggctacctccagatcggtgggtagggtttgggggagagcgtgggctggggttcagggacaccctctcaccactgccctcccacaggctccttctacaagggagtggcagagggagaggtggacccagccttcggccctctggaagcactgcgcctctcgatccagacggactcccctgtgtgggtgattctgagcgaggtgaggctgggcagggccaggccaggcacggggagcagccagggagaccctggcggagctcagaggccctgctgaccctgggtccggctcttccagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaatgtgagcgccctgggcatctccctctgcccctgcggttggcttcatttggtctgtgccccaacatgccaactaagcctggcactgggcctccccagccagcatcagcagcgacctttccctgctaagtcaaggagccagcctggcctgcaggcgcggggtccagcccctggctgtgcagctgcagtgccacctcggcgccagcgtaccccccttcctaggatcaggccgcaaagtctgtcactggtgaaaccagctcagaatctgggaccacaatgcctatagcaggtcccccgaatgtctcccccatgtccaaggcctgcgatgaggccttcccttagctcctcaagctgaaggcatttcccagcctccttgttcccctccgtgtgtctcagcttggtcctcatcctgggtccccgacactcctctggcacattagggtctcccgctcacctcagggcctttgcacacactgttgcccctccttggaaagctctcctttctccgtttctcctgcatacttggctaaaagtcacttctttgtttctgtgggcctcccctggatccccaaggcttctggacatttccttgagaccgcctgtcactgactcacttcgttcccatggtgcccgcagctctgcggacctcggagggctgccctgaacacctacagttaacgagggggatccagtgctgaccaaaagaaaaacccctgccctcacctggggagagagccacaggctctatctagtgtcagctgtgaaggccaggggacgagggactgcggcggctgagagtcgagggaaggcccctgaggagggggaccggtgaggagaccgctgagcgctaggagggtgaaccccggcaggactgggcggccttgtgaccccgaggctgagtagggagtggggtaggaggtgaagaccggatccagtcccgccccagggggagggctcgttccttcgcagccactctcacgccgccactaggaagcccgccccgggctgcccggactcgggctgggcccctccaggctccgtagcccgcggtgcgccacccccgcggacccagagaacgcagcccgggtctcggtcactagaactttaatgatagagactaggatgcggaagcgagcgcccctccccggggcagctggaggctccggctcttctttcccggctccgtcggcccgggggccttggtctcaggcccacggcagcagcgtccggagccgtccgaggagcgcggcgcgcagcgcggccgggaggaagtgggcgagcaggccgagcgcagccagcgccaccagcagccagagggcgcgcgcgctcgcgtacagcggtgccagcctgcgggcggcggtcagcggggaggtggcgcgaggaggcccgcttcttccccgccgcaaccctggccccacggggacttcctctggccgccgccagggctcgcccaccgaatccccaaaggcgctgggctccggcccgtcgcccgcccccagcttcggtcccgctccccaggagccccgcccgcccgcgatctttccccggccccgccccgctccccgcccggccctcacctgagctgcgcggagcgcgcgtagccctggaagtagcggaggcgcgcgaacaggtagaccaggccgcacagggccgccgcccctgcgagaggtacgcacgggcctggtgagcgccctgcgcgggtcccgggggtccagcgcgtgcgcccctgccccacaccccgaccttcatgaaagaagatgccggcgacccagagcgtggcgaggaacagcgggaagtactcgctgcagttcaccctgcggtgggcgggtgggatgagcgcgccggccgggatggtcctgcgacccggacccgcctggggctcgctccccgccccgcgccctcccgccgcgcctcactgggctcggtagacgcgctcgaactcgggtgggccggtggtgagcggcggcgacacgcggaaggccctgcgcgccgagatcacctgcagggagaagtaggctgggggaggagggggagcgggagtcaggtctggacacccgaagccccagagatgggagtgggagggatcctgcaatctggcccttcacttggccgtgtcctctcctccctaaggcggaaccccgccccctccccgcccgaggagacctctcgtctcacccatccctggcctgccctgtgtccctgacattcagcgaggagggcagggctgaagcctggggcgcagagaggccctgtcccaacctgtgagtgtatgggggagggtgagtgattcaggcacagggacacctgctccgcgagagagaccacttgagtccttgtttctgaatcatttcactctcaaaacacaggcaaatgcagctttcaggtccctggccaggaagtgcctcgggagtctgagggcagagctggctgcatcctcccaggtgcaaggaagcacactccctgtagctaacagtccctggtcacccacctaccagcgcccaccagcagggccctctgaccctgcctcaggccgggatcactaaagcctgcgtccctgtgcctccaaacctcagtttctctgttcctgcattccggtcccaggcctaaatctgacagacaccttctctcctgctcccaggaggttgcagctgggactctcctagcctaaccccaggaccccagggctggggtagttgcagagggtgggctggccctaaagtttctctgtgggcaggagcccttctcttggtcaggtgaggccaggccagaccacacacagaccagtgctggctgtgcgctccctccccagacctcccgtcggaccatctccccctgagtcctgcagccctggcacctttggttctgggccctctgcagatgggtgtcacagggtggccatccagctcagtgcaggagcagctggaggtcaggctggcctgtctgttcagccccttcagagccccctccccaggctgtgccttatcctagcccacacactgtggagtagtggtgtctcttaggtggcaaggatatctggccaaggaatgtgtcctttagggccagtctgagaaaggcattaagcaggctctttttagggggctggaggaaggagtcccacctctaccctgctccacgtggtcccagtatggaggtgcctttgaagcagagccagggaatgggggccgcttgctgggacgcccagagaggggacagctggaaagagcagagatcagcttccccaagcccatggctatcctaccatttgtcctggcacccttgccacccccaagtcctacagctctcacagccaggtgccccccagttccctgaaagtccccaccctcttccagcttgggcctgggctggagtccccacctctgccctccacctgggcctagggggcagagggcaagctgtagggatctaaggcccaccctcttcctagataggaaccagcccaccttgcagcaggactcccaggagggtgacagcagccagtagagctacctcgtccttcatggtaccgtcggtgtggtggcacgggctgtgtgtgaaggcgagctggggaacgcttagccccgtctgctgctcagaggacggcccaggagaggaagagcagcctcggtgctctccccgccccatctcagtggagggggtgcacgggggtgtgaccataccacacagagccagggagccaggccaagccagcagggaggaaaccaaagtctgggcaggggagagcagctagctggagaccgcctcaccacttcctgcttgttcgtgccccttccttgcctagtcccgcgtggcagagcccaagctgtccatctgggtcagctccagctgtgggtgtgccccctgctgcaccaccccactttctccagggccttgcagacccccacatcatgctggagccagccccaggctcccggctaactcctccacccaccttatctgttccctgtccccatccaggctgttcctggcaacccctgccaaaccctcctctgcggaagcccttcccagtgcctttggcttcagaatggagtcccagcgcccccccagccacactgggccccacaagctctttctccttcaggaaacctcatgcctgccagccttagtcgttgtaggggttccatgcacaagggccaccctgccaggaggaaacctgtccaaggccccctgggtggcgggagggtcagcccttgtgggccatccctctcccaggcctctcttgggcctcccacaacagtcacctgctgtgtctttctgccccgcagccctcttgcctcaaggtaacaaccctccaccaccttcctagacggctgccctccccacactcaggccctgtggtctggacagtgctgactcctgccccttccaggcctgtgagatggacactgagccaaggctgactcaagatggtgagatgtagttctggaaacttccttaggactttgggacaggaaactcagagtggggagggggactacggcgggccaccctgaggacagagcccacgcagggccaggtggagaggaaaggtggcacccgaggactcctgcctggagttctgggtgtctccctcgccccgcctggagcgcccccggccgcccccctcgccctgcctggagtgcccctggccgccagccttcccagttgggcctaacggtcacttcctcttttggcttgagtgggtttgcggtggcttttggtcagaagtggcaaagtccagactgacccagaagcacgggcaggagctgggggaggccacaggccgtgctgcaggggtcgggccgcatggttctgccctcgcacctggtccttccttgctgccccaagctcagctccagcctgaggctcggagcctgttgggctctctcagaatcccttcttcctcctctgggtatcgcccctgcccccggaaaccagatatgccccagctgggggctctgtgagctcctccagggcaggggccagggctcaggcccggcccctgctttagaccaagctgtgacagtcatcttggggctcagtgatggaggactgcctcctagatcccggacacagatgtagtgccagggagcgatggtggccgcgtcctcagactctgcccactcagcctccttcctccctgaaacctgccccacagggcctgcctgaagggtgggatgcagcccaccacgcaggggttgacgctggtgccagtgggctgtgcccagggtgtctgtgtgcaccacgcatacatacctgcatgccccttggtcagttgtcacacacccatgtctctgtgcttgtgggtgtccaagtgtcttcgtgagtccaggccctcctgtcagccaagctctcatttcctccaaggcctgaatgtcctcccgtcggagttcatcccctcagtccacagcaggaagccaaagcctaacatcagcagcttctgaggaagtcccttggcagatgtgcagggcagggacctgggtcttggccccgggagccctccccgggtctcttggttcccacctccctccctctgagcctgcccaggctgtcagggccctgcctgggctcaagccagctcaagctgacaggagggccagccaagcccccacccctgctcgggccacccagcttccatcttcctgtctagctctggaggcaccagcatcaggagggaagcgaaagctcctccctgagcctccacagagccctaaggagtctctgatgcccactcaccaggacctctgggcggcagaaaggccggcagaaccattgcacagagaagaaatcagaacttctgtggagtggatcataggcagtgcacaactcagaccctgagcttgaacaagaaagtttatttagaaattattttatatttgagacaggatcgtgctctgttgcccaggctggagtgcagtggctcaacatgcctcactgcatcctcaaactcccgggctcaagcaatcctcccacctcaagcctctcaagtagctgggaccacaggctctaattttttttttttttttccagagatggagtcttgctacgttgcaggctggtctcaaactcctgggctgaagtgatcctctgcctcagcctcccaaagtgctgggattacaggcatgagccaccatgcttggctgaaattattttagacttacaaaaaagttgcaaaaatctacagtctc

SEQ ID NO: 10770 - DNA, 57945 bp, Homo sapiens
  misc_feature (1)...(57945): n = A,T,C or G, or insertion/deletion polymorphism (see Tables 1-2)
acaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttacactatgtgatattaaaggacttctccaatgactgggaggtactgaaccaagatgtttgtaaagaaacggtggggtgaggtggttaggtagaatataccgtcctggccatttctcttccttcaggcgagtaagcgctccttcagcagaaaggctgcggattgctggctgtgctctgtggactgggccagtaggtgtggcccaggtccaggtcctggcacctctgctgagtgcccagcctgagatgacacatgccatcctggagagaagcagagagggtgctgtctccaggcgttctccagacagcctgggcctggcttgctgagccagctgcaggaggggatctcctgactggggcttgggaccagatctgctgcagagaggcaataactctgtctaaaaagaaaacttgtcccgtgtgattacaaaaacaggaaaaggctccaagctaggaaatgagatttgaggtatggagaacattctcacctgatggaagcatcctgttcctgtacaggaggaggagctggtgcaagccctaggccacatatgtcacagttgttttggaccctccgtagcttttatactcataaaatattaaagttgcccctttcatatttgggtcattgaaagagcccaccgtactctaggttcctgctcactatgcacaacatctcagaagatggcgtacaaaactatttttctaactatagcacaggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctgatttgaccacatggagtattgttggtggtgacgtgtatcactgaggactctcttggttacaaatgacagaaaacccagccaaaactggctaacacaaaaggggaatgtcatggctcccaaaagccaaaatgcccaggggtgcctatgtcaggcttggtgtgatttcaccctcaaatgctgacaccaagacacatgccaactttgctcctcattgggaaccccatccccaggctcagggtggcagtagctccatcaacacaagagccagtccccaggaggtggcccaggtcaggacggtatttccctggcccaactgacttggttggaggcacatggccatcaccagccagcccctgtgatcacagatagaatgcaccgatggcctcagctggcatgggctccaccttcacagcccaggagtccatgtgtcttcacctgacagacaagagctgagcgttctaaggcacggttcccactgcagaaaaacaaacgacactgcacagacgggagaagtgaatgctgggggcaaaggcagcacgtgtctgacacgtgtggaaaagcactggagccagaggccgggtgcagtggctcacgcctgtaatcccagcactttgggaggccgaggcgggcagatcacttgaggtcaggatttcgagaccatcctggctaacatggtgaaacctcctctctactaaaaatactaaaattagccaggcatggtggcacgcacctgtactcccagctacttgggaggctgaggcaggagaatcgcttgaacttgggaggcagaggctgcagtgagccaggatcatgccactgcactccagcctgggcgacagagtgagactccgtctcaaaaataaaaaaataaaaaaattttttaaatgggcaaaggacatttctccaaatagacatttctccagataaaatatacaaataacccaaaagcccatcatcagtcatcagggaaatggaaatccaaaccacagcgagataccatttcccaccctctagaaatgagcatcaaaaaaaaagaaagacaataacaagtgttgacaagatatggaaaaactagaactcttttttttttttttttttttgagacggagtctcactctgctgcccaggctgaagttgcagtggcgtgatctcggctcactgcaacctccacctcccgggttcaagcaattctcctgcctcagcctcccgagtagctgggacaagcatatgccaccacgtccggctaatttttgtatttttagtagagacggggtttcaccgtgttagccaggatggtcttgatctcctaaccttgtgatctgcccacctcggcctcccaaagtgctggggttacaggcgtgagccgccgcgccctgcctagaactcttacacccagctggtgggcatgtggaatgctacagctgctttggagcgcagtgtggtcactgcttaaaaagttaaacatagctgtaccacatgacccaacaataccactcctcaatatatgcccaagagaattaaaaacacatattcacacaaagacttgtacacatgttcatggcagcattatttataatagacgaggggtaaacaatccaaatgtccatccaaatgaataaaatgcggtgcatccataccgtggggtactattcagccataaggaggaatgaagcatcaatacgtgctacaacgtgggtgaacctcgaacacatgatgggaagtgaaagaagacagacacaaaagaccacatattgtaaggttccatttatatgaagaaatggctagaatgggaaaaatgtatagagacaaaatagattgatggttgccagggcaaagccggggggaagtggggaatggcagctaatgggtaaggggtttcttttgacttgataaaaatgttctggaattagtgatgatggatgcccagcctagtgaatatactaaaaaccactacgttttgcactttaaaagagtgaacgttacggaatgtgacttatatctcagaaaatcaaaaagaagtaagcttagcacgcacatactaagtgatcgataaatgtttgttctttttcttcttataaaaaaccattctcgaggagtggtctccaggtcagcagcatcaacatcacctaggaacgagttagcagtgcaaacaccctgggagggagggggcagcaacctgtgtggctgttttttgttttgttttgttttcagatggagtcttgctatattgccctggccgattttgaactcctggcctcaagtgatcctaccacctcagcctcccaagtggctgggactacagcagcctgtttgaatcagccttccaggtgatcctaatgtatacccaatttgagaaccactgggattaaggaacaagacgactctttacctcctctcagggtgttaaaaagtgcagttcttccaaattctttccctctagagagcacaatgacaatattagttcagacttccaaggtgttgaagaaagcccgcctctgcatcttgaaagctgattcctatatccagcaacattgaagaagactgcagatcactctgggtgtcaactgcatgtacctacatccatcgcaccaagattcttgagtgccaatcacagaaacccacctggaagtcaggtccagctccaaggatggtttaactgcccccttccctttgccctctagccagaccctggtgagggttccagccagcagggtgaccccacatcccagtcgaccccggacaggccccaggcccgttgtcccaggtggagttgacagccccctcatgcagaaggctgtgtgtggactggcgctgcccctgcaggccaacactgggagaccagggacccgcattcgcctgcagccagcctcacacttgcgcagaagccgccactgggcccagggccagtccagaccccatccccagggccggccagcctctgtgacccgtctgtcaggggaggggcagcactgatttccaaggatgcagcccgtatcagggcctcctggcacctgccctgcgctggaagattcttctagtctcccggccccagtgtcagaattctgagaactggccgggcgcgatggttcactcctgtaatcccaggacttgggaggccaatgtaggcggatcacccgaggtcaggagttcgagaccagcctggccaacatggtgaaaccccgtctctactaaaaatacaaaaaaattagccgggcgtgttggcgggagcctgtaatcccagctaaagaggctggggcaggagaatcacttgaacccgggaggcagaggttgcagtgagctgagattgcgccactgcactccagcctgggcgacacagcaagactctgtcgaaaaaaaaaaaagaaaagaaagctgagaattaggaggaactgcaaaccctttccaggcgccctttgcagtgctaacacgccccgggttgcacgcgcaaccagccaaaagccgccaaactctgcttcttgacatccttctctcacactgcacagctttcaaaacgccagaagccctgctctgcacagcggctcccctgtctgcggactgggccgttccgttctggacccaggccggaggccgcgggctgcaccgctccaggaggccaggctggcgcgcgcccgaggccggggctgagggggcggcgcggaactcgggccgcgtgcgggagcgccacacgcccgccagggggcgccgcccgcccggccccgccccgccccggcccgctccgcacgctccgctccgcacgctccgctccgggacgccgacggcggcgggcgcttccgyctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtgagaggcgcgcgggcggccgggcctgtgggcgccgcggctgggctggcggcggggctggcggcgggcggcgggcgggtccggttccggcccggcctcggcgcgtcgcggcggacacgcacgccagcgcgcggcggggcgggggcgcgaggccaggacccgggagccgggcgcggaggggccggggcggggaggcgaggggctggcgggaggcgaatgcgccctcggcgggctctcctcaggtcggcttggggcggccaagtggagaccggcggcggcttctgcccggattcggcgcccgcgagccccgggggccgtgcagcttcccgggatctcaccgccgaaagttggcgagaccgccctgtcctcatcctccacctcagtttccccaggtgcctctaaggggccaggtgacgccagcgcacgttttcttttgccctcttcttcgtgcccatctcaccaaagtatcgcccttttagcaagatcagaggtccctggagctggccgcacccccattcccccagcttctcctcccccacctttcctgctcctggctgctctcagagctgcgcacccaaggctgtgggtagcggcacagggtgttcctgcaagctcgccaaggtggccctttgtgggcccgggtgccaccatsacacaggatgaagctggacaggcacccttggagtcgtgcggcctgtgggatccaggggaggcccacaggccactccctccgcaggtggtgtccggggcccctcatgctccagggcctgcgcccagcactgcaggagcccggctggctcgggctcagtgcctgtgctcttcggggcaccgactgttgccctacaggattgcggtcccagtgttgccaggtcgtccagtttatnaagagcattttctgtgaatcatcctgattttcagtgtgagcagctaatagccagatgcagacggaggcttctcctgggcnacgtttcttcatgtggaagagactgttctgttcccagnaacactcagtgttcccttcagcttcgggttccctcccagtgggcttcaaggatctcgggctcctgttctggacccgcctcctagatccagctgttcagtcggcagcccctgtggctaacctcgaagctactgcaagcccgatgaagaaagcgagggaccggcaccttttcttccgccagcgcgccagggtgtcatcagcgcgccagtgtgtcatattcgctggtgtacttgaaacacttgtgctgtgctcggcaggcttatgtgggtcgtctcattgaacgggcgggtgcaggtgcagcccggtctctgtacacctccttcctgcgggctcttctcctttccacctcactctccgtgtcccctgggaccgagctcccagggtccccccaagggaacccttctttgaaccctctcccaatctctccccactgctaggtttggtgtgtcctgctgtgccctctgacagggscttccctgtgccatcatgggcatcgtggcctcctgagtactgtcctccctgaagaggagcagacagggatgtggttttatccaagccatctattaaaaacatgccaacctagacttttcattaaagaatctgaatagctagcttggccaacatggcaaaaccccgtctctactaaaaatataaaatttatccaggcatggtggcacgcgcctgtwatcccagctactcgggaggctgaggcacgagaatcncttgaacccaggaggtcaaggttgcagtgagccgagatggcgccattgcactccaccttgggcgacagagcgagactatctcaaaaaagtattaatggactatgaaacaaaagtgttaaagttgaataacagcaataaaaattgttctgacatcaacaggaaaaatggtaacaaaatattttcagatcatgccaaaagcagcacttcgttaaaaggaagaaaaaatttcaagtaaaaacaataaacaggtttttagattgctcgataattcaattagtgaatcaaacaatgataaaagctatatatttcctgctgatttgtcaggaaatagtgacactgacaaagatagcattacctaaaatataaaagcaaagatagcgttgccacagactgcttaatgtgtgtcatctatcaaaggggtatatgtgatgagaagaaaaacttgaaatgccctcaaatgtttcagttcagaaatgaaaaaactttatattttcccaaatttgacaattctaaagatcgacttcttcagttatgattttttgaggctaaaagaaacttccttaaactgtcggtaataaaaaatcagtgagtcatggcaaaggggagacattatctttctgttcttgatatggaaaataatgttgcagaatcattgtcctgtgtgtgaagaagcgatgagtacaggaccagaactgtccggaagacgtatttcaggagacgcacatggcagttaggaaaacattgtgttggttttctggattttgtgatatttctgatattgttcttttttaactttaacgtgtagctctgtactttctcggtctaaagcaatacttgttttgtagtctagttttgtatacgtaaagagggcttcccagaattgtttaagctctggccccatgaaacttgtatctgcctctgcctgcaagtgtttctgagccaggagaagaagcagatgcttccaggaagaagtagaaggggatgtttttgatcgggatcagacactggctgaaggcctttgaccgcaggggtcattccggacgtttccctcgttgggctggaccctttgggtagcgtcaccatcctgtctgcctccggccagactcagccttcaggggcctcagtccggccctcccctcaccctctatgtctctctgccctgttcccaggtcttctcgtgggcaccctggacgtggtgctggactccagtgcccgcgtggccccttaccgcatcctgcaccagacccaggactcccaggtctactggacagtggcgtgtggtaggtgccctgagtggtgaggggtgctgggcarggcctgccctggaagggccgttgccgagaggaaggggtgtgtagcccacgtgtctgggtggtattccctgctgacagcatagcccaaggctgcaagagggaagtggaggagccttcgcttccatcttagaaaggcagctccgtggcccggtgcggtggctcacgtctgtaatcccagcactttgggaggccgaggcgggctgatcacgaggtcaggagatcgagaccatcctggcyaacacggtgaaaccacgtctctactaaaaaacacaaaaaattagctgggggtggtggcggaggcctgtagtcccagctactcgggaggctgaggcaggagaatggcgtgaacccgggaggcggagcttgcagtgagccgagatcgcgccactgcactccagcctgggcgacacagcgagattccgtctcaaaaaaaaaaaaaaaaaaaaaaggcagctccactggtcatggggacagggcaggagaggacagccccatggatccccatgtacctctagggacgcaggtgtggggctagccaatgtccacattctcatgccaccttttctcaaggtagacgtagtcggcctcattcaaagattccatatttgcaaattggcctactcaataaaatgtatttgcaatccccaaatcaatacttccagcgattttgtggtcatttggagacactcatggacacatgcacgttcaaagcagtgaaaaatttgactcgcctgatgcccatgtccccagctgaggcagaacaggacgacgctctgccttcttgattcagctctcatactgcactcacgtgtcctgttcacagtctctgcagtgccatgtttttcccatgtttgtgctcgttgctgatgacttggctgtttaaaatggctcccaagcatagcgcncttgttcctaagagcaagaaggctgagttgtgccttgtgaaggagatctgtgcatgagagcagcttcrttcaggcgtgagtgatagtgctgctggccgtgagctcaatgccaatcgatcaggaatacntattaaataaggcatctttaaacagaaacacatgtaaaacagttatgtatcggtcagtcgacagaagtgtgattagaggctccaggaacctaaccctgtgttcccccggggtactggttcaggattcgctaactcagtgttcgcggccaccttacagaatctgaccacctgaataacgagaatccgctgtagttgtcctcctaggtggaagcgcactcacccgtccaagagtgcggagggaagtcccctttcagcgggtacctgctgggttgagtttgctctgagaaaatgacagtcctagctgacgctcagacagtgcttcctgtgtgccaggcacttgcctgaaccacccggtacctccagaaggcataagtactttggtcttctctatgttgaaggtgaagaaactctggcccagaggggttgagtaacctgctcagagtcacacagctgcagtttggaccctctcagtacctctctgaagcagaagccacagtgcccttgttctccagggtagtggtttcccttgaaggcctgggagaagatgatgagactcaaaagtttgtcaacctcacggctggaacccagcttcaggaggggaagggtcaaggaagtaaaagcacagggcgggcggcaccccgggaatagccccactcccaggtgggcgctctgcacgggcatcctgaccagcagtgcccttctccnttgcaggactgaataactcagtaagagttaggaaggggagtttgtccaaggccaagcagggaagcccagttagacccccgatctctggcttcagagcctgagtggaccctgggggcagcaagagtttgccagaggaggggcttcctgtggggaggggaccatttctgagtgggccaggaggttggtgtgtgctaatgaggagaggagctgctttaacatgggcccttgagatttccatctctggcagcaagagctgcccgnccctggggagagaaaagtacgaggggcagagtgggaatccctttagtcacagcaggcctggtgctggggaggggcccagccacagccacgcagcggagcccatgtacgtagccccgtgccacacacttgacctctcccctcctgccaggcccaaagccctgcactggccctggctgtgcctccctttcctgccagccaggctaggccccagaagcaactcaccaagaccagacatggccctgccagcacctgcttagtgagtcctgacccttgagcctggtgttcgaggacacctgggggtctgcctgcctccatttctggccttgtctccccagctcacagcctggccttcagccggaccacacagctgcagggcctggaggagccacacccctcctggctgctgtgcctagtgtccgccatgccagctaaccttccctcccgctcctctgagaactgcccagactccacagacccatccttcctccttactcctctggacatgacgtgtctgcacacgcttttacgtggaagcccatgaggcngggagcttccgagggtgagggcaggctctgcagccaggcacccagggttaggattctgatttgatcacttcccagctgtgtgaccttgggtaacttatttcacctctctgtgcctcagcttcatctggtaaaatgaaaataatggtacctgtctccactgtgttctgagaatgaaataagataatccatggaaaactctgaaaacagaaacagcatttaatactctaattagctattatattatttttattcccagcacctagcatagagatggaatagtttcttagtatgaaatgaagattgagttacttttaactaatatttttaatgcacatatgtaaaaaaagaaatgtttttttgaggcgttctctttctgttgcccaggctggagtgccgtggtgcaatcacagctcactgcagctctctggctaaagcgatcctcccacctcagcctcctgactagctgggactgcaggcccacgcaaccatgcctcattttttctattttttgtagagacagccrtgttgcccagactgatctcaaactcctgggctcaagcgattcccctgcctcagcctcccagagtgctgggattataggactgagccactgtgcccggcctataaatatttttaattaaagtgctgacacatccacacaggcagcgaggaggagatttcttctgttttagttttctaggaatgttatgtgtaacagaaaataatacagtagagttgcaccacatgtaaatttgacttccaaattcaactgtgggttcctggcaaagaaaccgaaaaagaaatctctacctaccaactaggccttggcctctgtgcatcagggaaaggaggctgtaatagaaatgcaaagaaaaatgaaaaaaaaagtttaaagtnaattatggatgacttaaggggcttccaggagtaattctgggggccttttgtgactcactgcaagctgtgtgattctgggtggaatcgttttcccgtgggcatcctcccccaggccaatcgggaggatctatcctgtggccttgcttcttaggtcagggtctgcttgaggagatttgacaaagcaaacaaatcagtcccaagcagaacagccgggctgtgacacagccttgagcgggtgccacgggctggagcaggtgacaggcccagcctggcctggagggagggtcagagctgtctccagctggcagaagagcctggtcagggagggaaggaaggtggtcggggcaggcgtgccagcagagacgtctggttcacagtcacactggcctcccgagcatagygccgtagtgctcttgttcctaagagcaagaaggctgagttgtgccttgtgaaggagatccgtgcatgcgagcagcntctttcaggcgtgagtgatagtgctgctggccgtgagctcaatgccaatcgatcagggatacgtattaaataaggcatctttaaacagaaacatgtaaaacagttatgtatcggtcagtcgacaagagtgtgattagaggctccaggaacctaaccctgtgttcccccngggtactggttcaggattcgctaactcagtgttcgcggccaccttacagaatctgaccacctgaataangagaatctgccatgtcttggctgaggctgtcttcatgcctggtgggtgggcctcctgtcccacccccggacagctgagaatgattcagggtgtcattcactcctcatccttgtgttcattcagtacaggcaaaaccccagaaacaggtgctgggggtaggggagccaggccaggcagagatctcccctcatccctttgctcttcccccrgggcttcttccccgattccttaatgggagcaaacaattcttccagcctttgaaagtggcatcgtgctgccttctctacgtttttgttttgtgtgttgttttgttttttgagacgaggtctcactttgtcactcaggctgcactgtagcctccgcctcccaggctcaagcaatcctcccacctcagcatcctgagtggctgggaccacaggtgcatgccaccacgcccagctaattttttgtatttttggtttcgccatgctgcccgggctgatctcgaactcctgggctcaaatgaccctcctgcctcagcctcccaaagtgctgggattacagrcatgagacacggcgcccagattttctctacattttttttaatttccgttgggcctatggaggacagggaccccctccctcctaggtggggcagacacaaggtaagaaggtggccaggagaaactgaagagagggacagtagctactcgcctgcccagcaggagcctcgctggccaggggcctggagtcttgtaggaagctccggctgcttatctgtggatacctagatgctcaggaaagagctggactcatttatacaaagtatgactgtgtctgattaatcacctacatagcaaaagccacattaagttctttcaacttgaggaaaagtgtaagttagcaagcttgcaggcacacagactatttctaggacacataggagacttagtgactctccctgttggcttcagggacaggtggaaacattctctcccacacgactgtgattcagcctggacgtttaattttttgtttttttaccaggaccatttattactttgttatgcacatatccatcagcttaagagggaaaagcagcttgaagattctggtcacttagatttagcaaatgaggtcacccactttcatctcgcttctttgaatgtgcrtttaaggcctggggaattcatgatttttcttttactttaccaaacctcttctaggttcttcccgcaaagagatcacaaaacactgggaatggctggaaaataacttgctccagacactgtccatcttcgacagtgaggaagatatcaccaccttcgtcaagggcaagatacacgtaaggtttacccgccactctctgttctcacccttccctggccagcagtgttctcgtgtattatcctatttcatcttcacgatgtagggtgcgtccccattttacaaaggtggagactgaagtgtcagcgctccttctcttggagttgaaaggggcagaggaactcgtgacccaggaaaaccccttcttaccctgggtgggcactggaggctgctgaagcctagtgcggggcttccattcctacccaagtgccttggaaggcgtacgcagatagacggttctgtttgccagaagagatgctggaaacaattggatattttgagttgttttttataataaaactaacgttattttaaaagacacatgccctttacccaaaaattccattcttggcgtttaccctacagtgtattcatatatgcagaatatacagtttaaagggccaggtgtggtggcccacacctataatcccagcactwtgggaggccgaggtgggtggatcatctgaggtcaggagttcaagagcagcctggccaacgtggcaaaaccccatctctactaaaaatacaaaaattagccaggcatggtggcacgcgcctgtaatcccagctactcaagaggctgagacaggagaattgcttgaacccaggaggccgaggttgcagtgagctgagatcgtgccactgcacaccagcctaggtgacagagtgagactccatctcaattaaaaaaaaaaggccaggtgcggtggctcaggcctgtaatcccagcactttgggaggccaagacaggcagatcacgaggttaggagatcgcgaccatcctggctaacacagtgaaaccctgtctctactaaaaatacaaaaaaaattagccgggcgtggtggtgggcacctgtagttccagctaatcgggaggctgaggcaggagaatggcataaacccgggaagcagagkttgcagtgagccaagatgatgccactgcactccagcccaggcgacagaatgagacttcgtctcaaaaaaaaaaaaaaaaagtagagatggggttttgccatgttggccaggctagtctcaaactcctgaccttaagtgatccacccaccttggcctcccaaagttatgggattacaggcatcagccaccgcacctggcctgaatgtatatgtctttttctttctgttaggttattgccttaagttagattcatgggagggctcttaccaggtcaaagtcgtgtggtgcaaagttgctttgggcaggcccatgtgaattcctgataccagaacttcctaagcctggacagacattaccagctttctcagctcttctcagtgcactttggggttcaaggtgagacctggttacctctatctccaggaaaacaggtggagagagcagaagcaagcctttactctggtgagcaattgggcgatgataataatagtagttgtgacattattcactgcctcctatatgccaggcccaacaaacgcatcagcagaacaaaccaaatgactcataggccaaggaagaaatggaaattagaaaatatttagaattgaggccaggtgtggtggctcacacctgtaatcccagcactctgggaggccaagacgggcggatcacttgaggtcaggagatcaaggccagccatcctttgccaacatggcaaaaccctgtctctactaaaaatatttaaaaagtagctgggcgtggtggcatgggcctgtagtcccagctactcggaatggaagactgaggcaggagaatcacttggacttaggaggcagaggttgcagtgagctgagatcacaccactgcactccagcctgggcaacagagcgagactccatctcaaaaaaaaaaaaaagaaaagaaaatgattgaaatactactgcatgtcaggatgtgtgggatgcagtgagagcaatacacagaaggaaatttaaagccttcagtcttacaaaagaaggaaggatgggccaggcgcagtggcttatgcctgtaatcccagcacttttggaggccgaggcgggcggatcacgaggtcaggagatcgagaccatcctggctaacacagtgaaaccccatctctactaaaaatacaaaaaaattagccgggcatggtggcgggggcctgtagtcccagctactcgggaggctgaggcaggagaatggcatgaacctgsgaggcrgaggttgcagtgagccgagatcatgccactgccctccagcctgggcaacagagcgagactccgtctcaaaatacgctgtgaggagcatctttaaaaaagcaaaactctaaagagagaggatgacaaaacagccttaaaccagtacctttaagaatttagacaaaatggggctgggcgtggtgtctcacacccgtaatcctagcactttgggaggctaaggcaggtggatcacttgaggccaggagtttaagaccagcctggccaacatggcaaaaccttgtctctactaaaaatataaaaaattagctgggcatggtgtcgcgcacctgtaatcccacctatttgggaggctgaggcacaagaattgcttgaacccgggaggcagaggttgcagtgagccaagattgcgccacwgcattccagcctgggcaatagagtgagaccctgtctaaaaaaaaaagaatttagacaaaatgggcactttattagaataacatttattaatttccagttgcttctgcaacaaattaccatcaacttagtggcttaaaagaacaccagtttggctaggcgcggtggctcacacctgtaatcccagcactttggagagagatgtttagatcgcagctgcggtagcactggtataagagaagaaaaacccttttccttctccccatttaggttcttggctggggctctgttacaaaaggcagattaacaagacaaaaacagaagtttactaatgtgtgtatctcatatattcatgggagaaacttggataggtgactcaaaagtttagttggaattgggtttacacagcctcttaacacagggacaggccacttaaagaacaataacaggacagacgaaaanagcttatgcttccaagggcaggaaactgagaagataaatacgtgggatgaaaccgatggagtaaggtttgtttgcagatgcgtgcggtgtcatctctgggctgataggaatctagaattgtctccaataaaggagaacgtatatccagcttttaggcagaaagggggagggagggcagaaagagcttttcctgtgtttgctgctacttaattgccttcagctcaaaatacttcttatgtcaaaagggcatattttgggatggcatattgtagtttccttccctggctactcagaaatagaagaaatcagaacagatcccacctttcagtcctcacctaggctcatggctgtcctcactgcccatggacagagggatcgggggtggcccagccaccagcactgaccttgactgactagtttatcttgtaattgtctttctagaaaatcaatgtgtacattttgagctgagggcactgctgaggacctgttttaccccaggaggcttggggctggctctgtggcccagggggatgtctctgggcaccctgagccctgtaacaatgccagcagcatgagggagtatggacgggccctgaaactgcnggtcctgccgctggtttgtgtgcagggccaagaggcaggagccccctggcatacagggggccaagtgcaggacgtcctccaggatgtgataagagaagcgctttacagaacagagctgcagggtgatcccatttgggcaaataaagggggaaagaggaaaacatacatttgcttatgaatccattggtgtttgcatgtctggaaggaaccaggaaagtcactacagagagcgagaaaagattcccttttcactgaatacacatttctactgtatgcattttttaccatgtttatggataatgtttcaacaattttacatgaaaataactgaaatattcattttaaaagtgtcaggccagacacagtggttcacacctgtaatcccagcactttgggaggctgaggcgggcggatcacttgagcccaggagtttgagaccagcctgggcaacatggcaaaaccccatttctacaaaaagtacaaaattagccaggtgtggtggagtacacctatagtcccaactacttgggaggctgaggcaggaggatggcttcagctgttgggttgaggctacagtgagccgtggttgagccactgcactccagcttgggtgacagagtgagaccctgtcttaatttttttaaaaagrctctgctcacaactggtgatgacagtagttacgggagttgcaggaactttgtctagagagtcacacaggcagcgtctctcatccatgtgccttgactgcaagccagcaagagccactgactgttcccagctgtgcctgtagcccttagaccaaggtccatgagtcctgggttccctgggcctctctgctccaccctttgacctgtccgggactgtgcagggcaagcccttgtcctcttgccttcctccagggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaaggtgagcccgcccctcagtgtgccccagcccccacaccctcagcccctccctgccttcggcccccagatactccatccccacatggccaccagaggggtctccctgaaacccaaatgccaccttagcggcccaagatgggactgtccggccttggccaggcgtacacctgctcccagccgacttttaccatgccccccactcgctagtagggttctctacatggtgactccgcgtgcctgccctgcsctcttctgctgaactggcntattcaggcacacgtctgtcccaaattcctggtgattccatgtcatgcaatgccttgggtgcgtgccacagccctcatctgctgcaggttcctccctacagacatcccggccacaggatgcgagcctgatttcccagcagctccagaaagagccccagggtcttagccatccccaagcccaccaagccctcctccctccttgcctccctcagcccacagcctccctgtgccccctcctgcccttgccgcttacctgtcacgaccaggtggccagtcacctcccgtcagcaggggctgtgtcctgttctgtgttggccgcgctgtgctgtgactgttcacacctccgtgcgctcccacttgggggagctgctgggtgggtctcggtggttcacctccgcacnttcgttcctttccccttcagccactggtgggggagacactcaccgtgtgtggttggtctggaaggcagtggacacctcagtggcctggtccctccacatggagggcgtgacacagcccagacaggcctgggcacacaggaagtgctgcccccagagagcagttccctgggatgggtctggggtacagatgggcatcaggagcctcgccctgccaggccctaacttgcggtgtgtctatctctgtgggcacagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcggtgcgttgccctccagggctggggtgggctcatgtgagccaggttcgctgaccttggctgggacctgcctggtccaagtgtgtagacctggagaaggtgtccacattcacccctcatgggctccccacttgggaaggaagccaggtaaacagatcattgcagtcccgtgtggagaggcagcaggagatagcagtgatgtcctgaggataccactaatggggaggaagctcttcacactttattcctcttggccctatgatgggaaggggctcttaccatccctaggtatcagacaaggaagctgaggcacagagaggttaagtaacttgcctgaagtccctcggttagtgagcagtggagccaggatgtagccacctcagccagggtgttctgacacccccagaaaggctttggtaaatctgggctcaagtgcacggcctccntcccaccgtgattgacagctctcctgtataccctgagactccttggccagaggcctctcacagccatgggacccccaggggtcctgagtttgacgtggaagcagacctctgggtctgaagccagccaaggagatgggccatgtgtgggtctgagttccctgctgccctgtccaggggaccgataggcaggaacacatcatagcagccagccctcccgggctacttaacgtttgggttcctaggttgtagcttatgggaaactccagaggctggacaagatctctgaggttccstgggtcccacagccagcctgaccacagccagattcacacccttgtgttgagcgacctcattccagccaggccatttcctgcattgcacccacagactntggtccaggcccaaactctggggtccacctccaggaccagaaaattgtgcaagcatgttgtccttgggatgcaagtgacaggttggcttgttggaccttttggaaagaacacgagcagagatggaacatgactgctcctggcactgccggtgagaatgcagtcaggccctggtcaggccactgcggcccagggcaggcaggaggctccctttggggctgggagagtttatgtggacagagccaccaaaggggtgagggcctgggccaggccactgtcacagccatcagatacacaggtgtgcatttctgttagcagckgcatgctttagtttaagctccacacctccctgtggggagctcctcacctaggtttcaaggtgaaacctggggttaggcctgcccagggtggaagagctgcccggggccctccatctgagtgggatccagggcaggtgctctgggctctgcttgcccatcagtaccgagggatgggttgcacattgcccaggccagcatctaggtgtgtccttttcaaagcagtctcaggacacattgcttgctggccacttctccgctggttatgtgactgtctcaccttctgcctgctcactcagcatgcatcttttattgaactskgaggtccctgagcatgacttgctcaagggaccaccccagggatcctgaatctgatgtggaaacaggcctggggaggccccaaggcttccttgagagtgtgctggtcctgaccttgtcccctttcctcctgtcctcctaccttgtttccccagagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtcagcatcccctagttgagaggccaaggcctttccagccccgaggtgtcagtgggctcagggaccagcctgtcctgctctgccctgtctcactggggggtacctgggaggatgccctagcccaggcagtcacatgtcactcagtgatgggacaggtggagggtgtaggacaagtgagcccctccacaggcacctgccctgttggggaggcaggtaacatggtgggggcacactgcttgccctctcaggtcacttgcctagtggagacagggtctcccacgcgtgagtttccatcaggcctgccttctgggccctgcagggcaaagtgctgctccgtggctgcgcttagaggaccgtgttcctgcaccggtcccatatgtcactctcagaggccacctcaccagtcctctctggacataccaccttggcgtggctcggctccagcaggccatcagaggtcggctctcccctgtggggcggcgtcggctctcccctgtgaggctgcattggctctcacttgctccttcttgggtttcttggacttccacagtgaccctggtgggagcaaggccatctgtcctgcactgcaccraaggggtgtggacagcaaggacaagggcccttgcccaaatagaaggcatgagactgagtcaggacaggtcccaaggcctccttttccttgtggccaagcagggctctgactgtttaattataagaagaatcaagtgagattcttaacttaaagacctccctgccatttgcacaaatccctcaagttgcagatgtagctgagaataggtgtgggagagttgctgcctcagtttccccaagggaagtcagagggaaggaactcagaagagccacagctccaaaagctccaggttaagaggctcaggtgtgacccgaaccccacattctgttagcaccagggccctgtggatctgtccggggcactgtactgacctgtcccccaggcctaggggtcttcctgacacctgaggctccgtttggatttctcctgccgggcccttgacatctcagatggtagagagccctggcggagctcggggagcaggactagctcacactggaggactgagtgtgctctggtgatggaactctgcagctggtcagggtgggggccgcctgcccagccagcgctgacccctcaacacacctgctcctccacgttccagcctgcaggcttttgcgcacgcagctcactctgctgtgggtgtagtggactcttgaatttcactcccaaccacccgcttccatgcttccctcgggaagtgacccctcttccaccctttgcccaggtaaaagccacgtatcggcctagattccgacctctccctcctccctacagcatgtcttgccagctcaccccgcagagctcagcccttcctctccacggacaccacctaagacaccatcatctgctttagccactccctaaccacactgaaccccaacccccgcctttttttttttttttttttttttgagacagggtctcactcttgcctgggcaggagtgcagtggtgtgatcatggctcactacagcctccatctcccggacttaagtgattctcccacctcaacttcccgagtagctgggacagcagatgcttgccaccacacctagctgttttttttwaatttttaacagagacagggattcatcatgttgcccaggctggtctcaaacttcaggattcaagtgatcctccctcagccgtccaaagtgctgggattacaggcctgagccgccacacccggcctaacacacttagcccctttatggcgtatcctcccacagcaaccagcaaaattcgaaatgtcagtgggagcatgttggcaccctgcttagagtcctctagagtcttctcccacctgcctcctatgacctgtgagaccttctgtgcgcctctcccacctgcctcctgtgacctgtgaggccttctgtgcgcctctccccctctcagacctgcgcccaggcacaccccatggatatgttcacacacagacataaaaagtgcacactcagactgggcgcggtggctcacgcctgtaatcccagcactttgggaggctggaggcgggtgggtcacgaggtcaggagatcgagaccatcctggctaaacatggtgaaaacccgttcttctacttaaaaaataccaaaaaatttagccggggccgtgttgggtggggcacctgttgggtcccagcttactttggggaggctgtaggcaggagaatggcgtgaacccgggaggcagagcttgcagtgagctgagatcgcaccactgcactccagcctgggcgacagcgagactccgtctcaaaaaaaaaaaaagtgcacactcacctccaccactgcccagctcacactgtcctggcttctctggccttctcttcctccctcaggcagtcctactcccctctgcaggrtgactgctgtgcccccacccatctcttccccagcactcacctggctggaccaggtctcagctcagtggccgcctcccctgggaccacccagccttccctcttcccagcactcacccctgctgactgtgctcagctggtgcatccctcntccgtctccctgccaggccttgggctctgcagaggtgcccactgaaagcttgtcctgtgccctctacacctcagaggggttcagagccaagctccaggacccctgctgtcaaaaagtgttccctgggaacaagtgcagggaacagtcctgcaagcaagggactgcttgccctgctttcggacagccttctgagagccagtgaaggccagcagctgggctgaacactacatcatcctcagaaccaccctgcacagccggtgtgctccccgccatcgacaggaaaaacgggcccttagaggcacaggcaacttgctcggggttaggtgcagcgggtggcagagtcagaatgtgaggacagttgggccactcactgcattgtgcccaggagaggacagctgcatgacagtctgccattcacaaagcatgcccagctgcagggcctgagatgcagacacccaaaagagttctttcaccttctcaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagaggtgagaagccccttgggagcagcagggtcgagttgggcccaggaagagccagggcatccatcagcctccccgctggagcctgaccccatggttccggctgtgggcctccgcctaggggtggatgtgtcagagctggcaagagacccctrgcccagacccacactgcccagcaacatcacagcctctctgcacccccagccacacacccggtactcctcactcctgctgggcccattgcccatgaggaaccttctctggctgtcctttctgcattgctgctgcactcagagcaaagccacactgtggaggcctgtacacttcggctttgttcccatgaccttccctgccaggcgttcaggctgaagttcttgacggtagaactgcagtatcactattgtaccagcaaacttaacaagaattccttaatatcaccaaatattgtattcacacttccccgtgtgcaagtgtacttttcacggtttgattatttgaactgaggcagacgaaagtcacacatgtcactcttggttgataggtctcttaaatctgtttaatctacgggcttctgctccacctagctctcgtttattcttccacaatatttttttgaaggaatcggtcacttgtgccatagagtctctcatcgtctggttttgctgattgcatccgctgcaggcgtttagcaagctcctgtgtctcttgtttaagttggttgagcggtgagaccgagagccgtgatcacattcaggctcagctgattttggttctggcaggtccgcctgtgggcaggcttgaggtgctgtttattcccaacaagagatgtctggcaaccagccacctctctatgctactgtcagtcattgagaatatgcctggatccagcggccagtggccagcggcatgctcattccattcctcctttcgtctgggagctgaaattctcccaaagagggaagctgaccccaggcacagttcatagaggaaaggtggaatacatgttttactctttcctcttactcaccagttgtcaaaataatgatgagttggttttctagtgtcttccacatgtgaccagtgagttttttggtttactttttattgtaattatgaacgtatggatttaagcaacttgatgtgtgtctttccactggaatcactatgcttattctgtctgtggccagaggggctcatctggtctagccctgagagtccctgggcacgacactggtcgtctttgattccttgctttctggtgtgacaagatggatgtgctgctgctgtcgttgagtctgaatttgcaaaaacatttggccattagaagagtccatatgcaaattcacagatccagcttctctagaaaagtcagtgcccagccctaaaggccccatcccattgggcagcgggcgtgggagctggggctgtgcgtgtcctccatgctctagagccntgtgtggtctggcccaggcagacctttacattgtctgccccagtaatagatgctaaataaattactacgtcagtgagcgcatgggaaggggtgggcggaatcaatgtggattgcagacatgaagaaaggtgtggagaaggttgggcttcatctgggatttcaagaaagagtgaagttggattgagtggcaggggcagtgaacagggtggtcgagcctcctctgcctccatgaggccccacacttcctgaaagctgagtaagcaccactcacggcccctcccaggcactcggcttcatgcatccaaacacattttattgcattcctgttaggtgccagctgctattctaggccccaggagtagaacagtgaacacatcggacagagtgcctgttcacttagagctgtattccagtgagggaggcagtaagcaaataaacatacaatatgtcaggcagtgataagggctgtgggtagaaataaagcaggatgaggggatcaggagtgccaggggaaagaagggggctccattttctctctgttgctcatgggcaacctctctgatcaggcagcactggaggagaaactcgaaagaagcaggggaactagccatagcctgtctggggcagggtgttggaggcagagagcacagcaagctgggagacaggattggatgtggcacgggcttctgggaccagggcttaggagactgaccaggtgtaggaggtgagaccagagaggtggcagaaggccaagtcaccgaaagcccgtaggccctgtgagtgctgcagctttgacttcaggtgagaggggaagccagtgaagagtcatgaccagaggagggcacgacctgtttacgtgttaatggggttactgtggccgtccatgttgacagtggattagaggtgccccgtctagtacagcagccacgtgtggccatggagcactggaaatccagcgggtgccaatggaaatgtgctgtgagtgttcagatcactgtacacgggttttggagacttcgtatgaaaagaaaaacgtaaaatacctccatctttttttttttgggggggggacagagtcttgctctgtcacctaggctggagtgcagtggggcagtcttggctcactgcatcctctgcctcccaggttcaagtgattctcctgcctcagcctcccgagtagctgggattacaggcgtccaccaccacgcccggcttattttgtatttttagtagagacgggtttttgccatgttggccagtctggtcttgaactcctgacctcaggcgatccacctgcctcagcctcccaaagtgctgggattacaggggtgagccaccgtgcctggccactccatcattttttaattgattcctgttgaaatgygagtattttggatatattggattaagtcaaatatattgttaaaattaatctcaataatttactttaggactttacaatgtggctactagaaaatttacaattacatttgtggctctcatcatctctcttgggcagtgctggactagagagtggcaagaatagaagcaaggaggccggctggagcccatcacagaagcaggggcacaagatgatggagtcgagcatcaagggtaggaacagtgtaggtgtaagaaggggtcagattcaggagacgctattgtgataaaatacacataacaacatttaccattaagtacattgacattgctrtgccatcaccaccatccatccacagaactttttcagttttgcaaaactgaaactctgaacccattaaacagtaactcctcagcccccactcccccagcccctggcaagcaccattctacctttttgacttgaattgaactattctaggtaatgcacataagtggaagcatatagtattttcccttttgtgcctggcttatttcattcagcgtgatgtcctccaggttcatccctgttgtagcgtgctcaagatttcttttttaaggctgaatcatatgccattgtatggataagccacgttttgttcactgttgaaacttggactgcttccacctcatggctattatgagtaacactgctgtgaacatgggtgtacagatgtctgtttgaatctttactttcagttcttttggggacataccctggagtggaattgctggattgtatagcagttctatttttaatatttcaaggaacctccgtgctatgctctatccaccaactgtgcaccacagttggaggccagaccaccaactgtggcatgactctgtgcagacacagagccagtagctgtgctgaggcaatggcgggaaggaagaggggctctgatagtcctaagagccaaggaatccagaagtcaccagaatacccctcacaagagactactcagcaaatggaaacctcaacaagtgaatctgagagacagccagtgaaattgggagccgatttctcaggctccagtttatagaggaggcttttttttattaatggaagcacaaaatcctgctttatttctacccacagccttatcgctgcctgacgtattatacggctgaggaaagatcaagaatgtgagggaaacccatgcccttaacaaaaacttctcttctgaaagacaagagctcaccccaagaaaaaaaggactgggattgaacagagcaggaacacttggggtaaaggagaaaagctttagatacaagaaagaggtggccaatcccagaaagtacaggagsaaggactacacagaccgaccacagcaggggaaaggcctctccagctgtggagttcagaaagctactctgacccacaactgcccgtacgtagaacatcctgctgaaagaacaggaaaagatgctgatcacaccctgtacaaagatattgcggggagaaagtgaaccagataacctcccacagataatgaaagcacaccagaaaaacattcctccaggcagatgaaaactgtgtcctgatgtttctgagtgatctcaaaggaattagaaaaacgacagaaactactaaagaatggtataaattaaaaatgtttaaaaagctcaggttaaaagtgactagtcaacagaaaaatatgaagagagttgacaggactcaggaggaaataagaaaaaaaaaaccagatatttctgaaatgaaaatcaggaacacaagaatgaaaatacattaaggtaaataaggaagagataggagaaaaatggagtcagaggagactcaaacaaatagagaagaagttgtccagagaagggataaagaagttaggcaaagaagatcaaacttacgtataatcgtagtgccatcccacacccttcccagaaaaaarcagtggaataacagataatagaaactgtgattcaggaaaactgataaaataagcttgaacttgtatagtggaaggacacattgaatgtctagaaaaatcaacacaaaatagtcgatattgacataaaatctcataaaactgttcaattttaaagattaaaaaattattccaggctgggcacagtggctcacacctgtaatcccagcactttgggaggctgaagcaggcagatcacttgaggccagaagttcaaaaccagcctggccaacatggtgaaactctgtctctactaaaaatacaaaactaagctaggtatagtggcacatgcctggaatcacagctacttgggaggctgaggcacaagaatcacttgaacccaggaggtgggagaaggaggttgcaatgggccacgatcctgagagattcctcctcaagagaggtatcagactttgtgatacagtaacaacattttagagtaactttttgktgggggttggggagggtgtctcctggagtgcagtggcacaatctcggctcactgcaacctctgcctcccaggttcaagcagtcttgtgcctcaggcccgtgagtagctgggactacgtgtatgtgccaccatgcctggctaatttttgtattttttgtagagatggggttgagatttcaccatgttggccagactgatctcgaactcctgacctagggtgatccacctgcctcagcctcccagagtgctgagattatacagagtaacatttttaagatatacaataaaagaagctgtgacccagggattttatacccagccaaactgaccttcaggtataaagaccataggctgtaaagaacatgcagaggagttcaggggctctctcagcttctgtggagtctgctggagaacagactccagataaccaaggagtgatggaagcagcttgggcctaacgactggtggtagcattgattatatttagctgtggaattaaggttagatagtaggaatagaggtgacagtatataaatgttataatctctgatgatggagacatagtacaatcaaaacctgaggttagggaggtatatgaggctgggcttgatggctcatgcctgtaatcccaacactttgggaggccgaggcaggcgggtcacctgaagttgggagtttgagaccagcctggccaatatggtgaaacctcgtctctattaaaaatacaaaaattagccgggcatggtggcacacacctgtaatcccagctacttgggarcctgaggcaggagaattgcctgagcccaggaggcagaggttgcagtgagctgagatcacacctctgtactcctgcctgggtgacagagcaagactccatctcaaaaaaaaaaaaaaaacggaaggtatatggaaagatatggaaaatagaataagctcactgattgccttattaattaaaaatatatccttttgatcagatgttggcagagagggaggaaagtgggaagaaaaggcctgctagctaatttcaatattgcttgtagtagggaactgacatcttaaaaagagaggactaagaaactatataatgatattagcataaaatgttacagtataaatatacactttctaacagggaaaaaaacttgaaagggggaaaggagacagtgagattaagcatctctttcaagaaattttgtataaaggtcaacagagtaatggaggtaacttctgggagggctagaattttaattgaagtttaacatatatatccaaaagtaaacatacggtgtacaactggatgaatcttagcagagggagcataataggtgaacagcacccagccaaagtgagggtgggctttagaggagtaacagtgcagttctgtgctgggagagcgactcctgcagagaaggcaggggatggggtccaggtgcaggcaggtgggcgggcaggagggcacccgtggagggctcggattgttccctgttctcagttaaacaggaagaagtgtggttcagtgggatgcaaggatggcaagtggttttggaggtttatgtgaggtggttacctcggggaagaggggaggactggactaggaatacataagatcccaggcagctctgagcacccacctgaggccagtaagcccgaatgtaaggtgggacttgagccaagcttctgccgaaagccgcctggtccctgagcttggtgccacgcttgccgcctcgccaggagcacacgttggctgcacgccacacacccggcggtctggccccttccctggccaggagcacacgtctgctgcacgccacacacccggcggtgtggctccttccctggcactgagatgtgtgatcctccaaggcacctcacagcctgcgagcccgtgtgtgtcctagtcggtccctctgggggagctcaggtgggaagcaggatctccaggcaggcagtcagtctgcgctggggccgtgcccactggattcaggcagcttgtcgtcaacatttgtttaagtggacccaaaatccatttctaacatcacgggccagaggggtagactgtgggtgtgaacctagcagagttctctctttttttttttcctttttccttttatattaataacaactttattgaggtaaaattgatacgcaatacactgtacatatttaaggaatacaatttggtacgttttaacaggtatacgcccatgaagccatcaccacagtcaagatcagggttctctcaaaaaaacacagaatgtgaagtgttttaggagggcgcccagcaccctggcagctgccccagccctgggtggagtgggaccgtggccacgggaccagagccagtgggagggtgtgaggggtagagagcccagcccaggccagagcccaccatggggaatcgaccacctgcccagccaagaagttcaggcagtcagctggccctggtcgagctgggctctcccccactggactttgctttctgccaagacagcatcactctcaggcccgtgtggcaccatgatggcagcagcaggccttgcatgctccctgggttatcccaacactcctgcagaagggccactcatttccttggtagcaaccgggtgacgcagtcgccctaaacccaccctgagcccagcccaacatcacaggccatcacccagccctctgtgcagcccaggaagcatgggcccgagggtgggcaggggtgtgcctccacgttaggatagggcctctcctgtcctttgcactgacccccctcagaaaagggccccacagggtgagcccagaacccgctccctgagactgactcgctggtgagagtggggttaattactgaggactcggtgtccagcagccagagaggagctgagggctgagctgcagccacagcctcctgcccagccagacaggctcttctccgtgcaccgtttgcccccatggcccttcttgcaccgggccccgatccagctctggatggatgggcgcatcagaggccacctggcagcacagttgttagggcgtccccttccctgttttattttctagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggtgagccctgagcgccggcactccagcctccgtcaagagcggagccctcaggaggaaagctggagccagtcctgggcctgggccttccctcagggccctgggctgaccgcygggcagtgcccacccaggctgcacccyggcagcgtgagacggagcaggcactctctggggggctccgctgacctgctcagtgtgctgtttgccacggactccaggcctctgaagggaagggccctcccgctgaggagctggtctcctgagccttgggaggtgtggctcagcgcggcctggtctttcccgggaattgcgaggaaggccacacttgctggccagcactgtctggagtgttcacgaggcttccgcggtggcctaggcctcggcactcagatgcgcttcggcccccaggctccctgatgcgcttttccctcaggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggtgagtggggtgcagccacccccagcctcagctcagccagtcagtccccaagctctccccgtgtgagctcgtctgtcctgagccggcctggagttggccaggcaggagctcccagctctttcacacagccgggagccgggctctgggctctgggctctggcccrggacccaaccagaaggagcatctcgagggacagaggctggggaatgggcactctgctggccgggtggtgccctcccgcccacagcgggagggaaacaggtcccctagaggcctcctttccttgggacaggctctgacagcattcacacccgtggttgctggaagaggcaagtcagccacttgaactttcgggtagagcaccctccccaggagcacaagggaaaccttrcctcgcagcttgtgcttgaccccaagtcccacctctcctctgtggggcacccggtgactccaacctgccctgttactgcmcccaaagtaccagaagaaggacagagacagctggcacccgtgtctccccaggggcctggaatgagatggtgactcaccccgggtactatgctgagctggtggagaagtccacygggaagtacagcctggccacagaggagatcgagcgagacctgcaccgctccatgccygagcaccctgccttccagaacgagctggggattgctgccctccggcgggtgctgactgcctatgccttccgaaaccccaccatcggctactgccaggtaagggrcctgacaggggcccagagacagcatctgccaccagaggttcacaggagcagrtccctgtggtcccaggcctgtgtggtgaccctgccttgtgtcccaaggaaggagcccagcagaaaaagatgtaatttaaaaacagtattaattgctcatcgcatccccatgccgaatagaagtcgtcgtctttgtacttttgtctgagtcccagcagcatttgattgttgtatgtgtttggtgaaacaggcacatacagaacataaaatgtcccatcttcactgtttttaagcgtgcagctcagtgctctaagcacattcacactgttgcacgcccgtcaccgccatccatccccagacctctcttcatcttgcaaaaccacagctctgtgcccattaaacatgccccgatcaccattagcaaccactgttctactttccattgctatgaatttgactactgtgtctcatataagtgaaataacacagtatttgccttactgtgcctggcttatttcacttagcaagatatcctcaagggtcatccatgtcatatgaatgtgtcagaatttctttctcaggctccatcatattacatagaccacattttcttttcttttcttttctttttttttttttttttttgagatagaatctcactcttgtttcccaggctggagtgcagtggtgcagtctcagctcactgcaacctctaccacccaggttcaagcgattctcctgcctcagcctcttgartagctgggattacaggcatgtgccaccatgcccagttaatgttttgtatttttagtagagacggggtctcgccatgttggctaggctggtcttgaactcctgacatcaggtaatccacctgccttggcctcttaaagtgctgggattacaggcgtgagccactgtgcctggccagtatttctatttttaatttattttaaattattattattattwttagagacrgggtcttgctatgttgtccaggctggtctcaagctccttggaccaggggatcttccggtctcagcctcccagggcatgtaccaccacacccagctaatattttttttttagacatggggtctcactgtcttgcccagactggcctcaaactcctaggctcaagtgatctttccgcctcagcctctcaaagtgctgggattataggcgtgagccaccagccaccattcctgggctttttttttttttttttttttttttgagacaggatctccttctgttgcccacactggatctcagtggcatgatcatggctcactgcagcctccacctactgggctcaatcgatcctcccacttcagcctcctgggtagctggaactacaggtacacaccaccacgcccagttactttttgtattttttatagagayggggtctcactgtgtggcccaggctggtcttgaactcctgggctcaagtgatccgacctcctcagcctcctaaagtgctaggattacaaagtgtgagctactgtggcctggcctatttttaattttttgaggaactccatacttcctccccagcagctgcaccattttatattcccaccagcagttcacaagggttccgatttctccacatcctcatcaacacttgctatattctgttgttgttagagtgatgggcatgagggtatctaattgtactttaggttagcatttctcgcagcttttgattttaaatctaggcattttcctggccaagtcatatggctttctgtttgccttaaaggtcttgttagcagctagggctgtgtgtggtcctagttgtgcaccgagtgggtggccttggtgtggggctctggccttgtggctcacctccacatcagcttggtcataatcccacctccaacacccaacaccactccgcagaagtgtgatgtgttgatgttcaccttctctggtttcccagtgccttctgacccagtttgaaggagttggcagactctctgttccatcagtttcctacaaattgccttttgacatttcccagagttgggtaggggcagtttctcattaccggatgcccagccctcctgaagaggcagatttgcttgtaggaggaggccattaatcttcaccacgagaacctgaaaaataataaaaataacaacaacaaaaagaagatcatgtgggcccttgcagggaggggtggctgggaggggtggggagagacagttttatttgctggccagcagtgcaagccttccccggctgtctctgtgcccggcaggcaatgaacatcgtgacctcggtgctcctgctctatggcagtgaggaggaggccttctggctcctggtggccctgtgcgagcgcatgctgcccgactactacaacaccagggtggtrggtgagtgtccccgggtgctgcctcgcctgggtctccaggtgcctgctggttccatgagggtggcagcccttcccaggccaagctccaggcttcacgtgggttccctaggagttagagggtagtattacacattcggtggtttataaaagtcccctcagagcctaaattcctatccatctaacttcctgtcaactttttgattatggaaaatttcaaacatcaaaactagagagtatatatcccccatgtaacctgatgctcaactttactgaactcatatccagtgaaatctgttatgaagtggaaatggacttgcaagagtgtttaattaggttcatatttaagcatgttatcctgtccttcccctgctgtctggtgtttggagttaccgctcttggggtccttcagagctgcgtctattcacaatcatcaggatgggacagagtcattgagggtgctgtttacctctcatgccttacggagaaatcagtatttccccaaaataaaattcaagtgtagtagaagaaatagttatttcgcccagtggtttgggagctgtagagagacttgaagggttttttcgtccttgttttctcccagcactccaagtctccctcagccctcactgcacagctggcagggctggagtggccagggctcgtacgctgcaggtgagggcccacccaggccacagggtgggctcaccatcagcctcgctcatcctgcccgcaggagccctggtggaccaaggcatcttcgaagagctcacgagagacttcctgccgcagctctcggagaagatgcakgacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcaggtgacatgccgggttccttctcctgctgggggctcacagcagaacccctcaccagccccgggcactgtccagtcagcctgaagtgactgtgcccaccaagtgccaggctgcagctggacccgggggtgctctggggtcaggaggcggctcctttctagtgggagatgaagcagcgctcagtgataggtgccaggaggagtaaagcaggcactgcgggcagagcatgctggctggagggccaccgctcagatgtagggttggagatgcttcccctgagggcaaaccagagccaagatccagtgaccacaattccagttggtggcacagctgggcatttcatgtccaccaggtggtcccggtcatacctctccaagctcagctgcattgcagcccccatgccctggagggagcaggcctgccctgggcccgctggaacagctggatgagctgatgtcccactagtcacgccaaatgtccagggtcatcccagcccctccaccccctccttagtccccacatcccatctcttgcagattctgtctgggatccagccccttcccttcagcctgctgcctcagcccaggcccaccatgccctttccctggggttcccctctcagtctttgacctgcctgcatcccargactctgatcagacctggccctgccccttccctgggtcctctgtacaaaggcactgtctgagcctccagcctggccttcaagccccggcccctcctggctacactctgccctgccctgagctctgtgcagtcccaccctcctacatagcgtatttgtccggactggaatgcccccagcccccaggaacagcctgggactctgccacttgcccatggccaggccaggtgctgcctgggactctctagatccagcagggttgtcacctccctactgtgggcctaagtagcttttggtccacactgatgttaagatactcagcctgtggccggagtctgtggctggttttcctgccgcttcctacaaraggcggatagggcctcctccagagcaggggtctgactggggatatgaccagggctatgggcatggggagtcagctacctcctcccacctgagtgtcaggctcagcccagggacccagagaggccatgaactctggcggggctaggtcagctgacagaggtagngctccatccccaggactgtgtccctagagaagctgattccctgggctgcagcaggcctccccacacctgactttctcctgcgactcaacctttgatccctgaatcttcttggccagggcgagaaggtcccacatccccagggccccgccaaagggaggaagctcgtcatccttccaactgggtaggatctggggttataaggcgttcctgcccaagggacccccccactgactaagaaaacagcccagcgtcctcagggttagtgctcaggccttgtcgggggcactgccctgtagagggctccccaacttgctgggggcgctgccagggcacacctctgccctcctgcagggtgcccagtcctctgcacactccttattaggagtctgcataaagattgggtccctccgcatcacccagctgtgggaaggaggctccctctgcctgggcgtggtctggactgttgtcctctgtcctttgcagatacctggataatgtggtcaacaagcagagtgtctctcctcctatcccgcacctccgtgccttgctgagcagcagcgatgacccccctgcagaggtggacatctttgagctcctgaargtgtcctatgaggtcagcacccagtggggccattttggccaggccgctccatctggcatgtgggttggggtggctatgggcaggtggtggccctctgccctgcagttggcttgatctcaccaagtcacctctccctatagaaattcagcagcctgagggccgaagacattgagcagatgcggtttaaacagaggctgaaagtgatccagtccttggaggacacggccaagaggagtgtggtatgggtgccagcagggctgggcvggggctgggctgggggggcagcagtgccttccccacagagcagggtgggtacagggctccrccgcacccagtctcctacactgctttggtatgtacatcatggtaggattcatgggaccgggatccaggggtgtaggtgggaatgtggggagaggttccagtcacttttctctgctggtggatgtgtcaccgggaagcttctcagatggctcccaccctgaaagccacatgcccagccctctgggccgagcccgcccagcctggcttcccatgtgttccctgccccactcccaggtagcaacatgccgccatcctccgcacaccccaaatggcatgtgtctgccacaagctgctgttctcatctctagaggggccaggccctccctgccaccctgtgctgcaagacctgtttgtggtctctgcccccaaaggcagggacttcctccattgtttccacattcccagccctcctgcaggcttgtaggacactgtaaggacattggrtcgcagcaccacagactgactgctttggccaattaaagtacaggagcattggctggcaggttctcggcctccttccacagagctggcaccagggtctctgcagggatccagatgacgggagccaaatgagtatccctcactctgcgacctcagctgcacgttgaggacagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccrgagtgtgagagagaggctcccccacgcccatcctgggaaggggcccggagtgtgagagagaggctcccccacgcccatcctgggaaggggcccggagtgtgagagagagactcccccakgcccatcctgggaaggggcccggagtgtgagagagaggctcccccaagcccatcctgggaaggggcccggagtgtgagagagaggctcccccangcccatcctgggaaggggcccggagtgtgagagagagnctcccccangcccatcctggaaaggagcccggagtgtgagctgagtggtaggtggggggccagggatgggctgtgggcctcgctctctcccgaagggtccgcccttgagtgctgggccactgagagggcggttcacacccttgcccttgtctgccgaggatgctctcacagagtgccgtacttctgtgccaggagcttgtgatccagctatataccctgtttctccttccttctaggtccgagctatacctgtggacattggtttctccattgaagagctggaggacctttacatggtgtttaaggtgacagctcagagccagggcaggacccgttcctagcttcctagcttcctgccagaaaagaaatggatctaagagtatcctcttagaagtagatagaaatagggaatagaatagaaaaasagaaacagatctaagtgcatcctcagatgcagttgccatgaacctcctgtggtagaatcgaatccctcttggagtttaggcaggacctcttaaatggcagcaaatccattcragtcatcttacacagaagagggaatacattgcccctgtattgctagactgaaaagtctagcaatgcacagcttcaggcatggctggatccaggtgctgaaatgtgccgtcaggcttccccatctctgatgtcctctgcactgctcttcctacaccatgccaggactgtcgtcacagctccagggtcatactctcttctcagtaatcccagtgcaaagagaatttttctttcccttgtgcttttagcaaaagacccagccttaatggttggaatctgcctttctgttgttgttgccagttcccgtccacctctccagctgcctcaggttccgtgctcaaggtggctgctgcgctgtggcnctagcgtcacaacagttgagccagctctgcctgcctcctagagaggtcataggagcgagagcaagcctcaggcctcttgtttccctggagccctgccaggaaggctcagcccttctctggggccagcagaccagctcngccccctgcaggctgccaaggactctgtctctcagccaaccccctccccatctgttaacaaggggctgatgacagcctgagagctttcgggaggtgctgcagtgtctggcccgtgcttaccgccccagggctccgcaggcttggacagagggggagggtggacacaccaccagcctaggggtcccctcgacccacaggcttagcggctggaccgtctcaccagaccgtgtcccacaggccaagcacctggctagccagtactgggggtgcagccgcacaatggccggccgtcgggaccccagcctgccctacctggagcagtaccggattgatgccagccagttccgggaactctttgccagcctgacaccctgggcctgrggctcccacacacctctgctggcagggcgcatgttcaggctcctggacgaaaacaaggactcgctgatcaacttcaaggagttcgtgacngggatgagtgagtgcctgcagggcctaccaggggcttgaccctccctcaccctttcccaggaagcctccaaatgccagcatctcctgtctgttccccctgcagcaagtagggggcagcttgagcccctggccctagatacgggaagaacagtttacccacgggagccgagatggggtccagcaggagccttgcccgctcccctccctcatgcagtctggggctgctagaagctggtctgccagccccagggaagggctgagccttcccagcaggacgccagggagacaggagatctgggactcaccctgtgacctctccaggagggagttgggcagcacaggctgtgaagagggtcctactcggaccccctggaaggggctctgcagccatgttgccagacccagccctccctggccttctccacaggcgggatgtaccacggggacctgacagagaagctcaaggtgctctacaagctacaccttcccccaggtgagagcctcctgccnactccccagccagggtctcccacttgtccagaagttcagctgcagaggacaggcctctgtgagactgtggggcctcgagggggcacagcagcgtcgcaggctggaggttcacattggaggagagggagcgggagcttgagcacttcacagaggtctgagagcagggccttggcctgggaagggacgtggaggagaatcccatgggtgaccgggcactgctgggtacagaactcccaccgaggaggcagctggacccaaaacccactaggagggccatgagtggagcttcagggctggaaccgaaactgctycatttatctgtcaagtttcttaagggtttattcccagagtttcagctagagaatcctgtcacatggccatgaggaggggccacttctctctggcctctcagtggtgctgtagcctagtggggctgcactggcgacaggctgtctgtgcagggggcagggctcagcaggagtggctgcatggacaatgctccaaggaggggtcatctccctcatcacagaaggaaacaaaggcgcaggcaggtggaaatcctgggctgggcactctgctgtggctggacctgccccaggtccctgctgtcgctttgccatctgaggttagcagctgccctcagaaccgaccccggggatgtttagaatactggggctgagcttcacccgaggagattctcacttgattgcctgtgatggggcccagacctgtggtttttaaagctggcaggccattgctctgtgcctccagagctgaaggctcttgacatagctgttctcgtttgtggctggctcaccagagaggccgtggtaggacagaccccactgggcctggtcccagggttgagagcatgcggggctaccctgagactcctgagcctcctcagcctgccctgccctgtcctgtccagacacagagaacacttgggctctgctgggcttgtggcccatgcccgctacactcacccaggaccatgcgawccgcaaccctgggtactgcttggtgacctccagcaaagactgcactgaatgaggccggccarcacgcacaacgcggcccgacctctgagctacccaaagggagagcagcaagttgcctgtgcgtggctggttcctgtgcgcccataggagcatgaaacgcccccaaagggcccactggccagatggtcactggggcaggcgggcagctgccattcactggactcctaattgtgttgattggatttttacctgggacatgtatttccttttcaaacacaatgtcaaagtcaggaaagcggctggatgcagtaggaggcccaggcgggtggatcacttsaagtcaggagttggagaccagcctggccaacacgatgaaacctgtctctactaaaaatacaaaaattagctgggcgtggtggtgtgtgcttgtagtcccagctacttgggaggctgaggcgggagaatcacctgaacccggtaggtggaggttgcagtgagccgagatcgtgccattgaactccagcctgggcaacaagagcaaaactccaggctgggtgcggtggctcacgcctgtaatcccagcactttgggaggctgaggtgggagaatcactgtagcccagtaggcggagcttgcagtgagctgagatcatgtgactgcactgcagcatgggtgataaagtgagagtccnttaaaaaaaaaaaagctgaggaaagtaacaaataaccagaaccaatcatcaccatcaaaactattaccgggcactgtcatgggcaggtgctgggactggccaggctcgtgggcagggaaagcaaggctctgcccagggctggagggaacttactctgagaggatctccttgtttcctcctgccctcactctgccttctctccaagcacagctctgagcccagaggaagccgagtcagccctggaggcggcccattatttcacagaggacagctcctcagaaggtgagcggccactggaacacccgacatgcccagccagcactctgcagccaccgccgccttcctgtggggctcgggcagtggccagcagtcccacctgggctcagggagcaggccgcatggggttctccccaggggaccacgggctgggctctgccatgctggcgggggctggggccgccccctgtggatgtcctcactcctgtttctcttgtgtctctgtcttcctggaccttggctcctccccactctgcccctctgcctctcctctgctgtcccttccagcatctcctctggcctcagatctggatcttttcctgccctgggaggctcaaggtcagtccctggaaggcaggggcgccccctgtacctcctaacactcttcctgcactatcaggaagcctggaagctctttgtcccagggacctctctgggacttcatcctctggggcataagttctgagaaggacccagaagcaagccactcctctgcaccgcctccgtgtctgctgtaggtgggcggtaaataaggcccccacactaggcgccaagcaggcccagggcaaggcctccacagccacatgttagagacattctgtcttcctgtgagtaggaaacaaatacaaaatgctgtcattggagcgtgtgaaagacacagtgtggctgagtgggggctggaaagaatagtggatgctttcctaggaaaaatcttcatgttccacgtcacgttttttgttaaggaaaaacacgcatgttgagtgcctgttagaactcatccctgtgctatgtttaaagcctgttgggagcatctgatcccaggtgatgggagcatgctaggccctgggctttcgcagtcgagctggtgacatgcagcacacttgcaaaaccgaccataatgccacctggtggtttcacatgggggataatgcacaccaaggaaccgactcaaaagagaaccaaaaatagtgtgtaccaagatgcccatggcagtcctggtgacagtggcagaggctgacttgagcttgaggaccttgatttcaaggacagaaactacagaagcaggtacaccttctgttgtacatggaaccagcaggccactctaggcttgtcccgcatgcttctgggagcggcatgttggtgcagagccctggcctcagaccgcatgtggcccccaggaagcagggcctccattccagggtgagttgcctgagcccagagaggtgtgcccttcactgccaccagacagccagcgagagcagctcagaactggggtgctgccgacctgcctgaggtgcccccaccagccacactgcctttggggaacagctccaggagagctggtcggctgcttctctccccaggtgcatgttcccacgcagggagtatagtgcgcgccagttccggcaaatgtcctccccgaaacgctgcaccaagcacaggagctgtgcacagaccacccctcagtaacaggcacagcaggcgcgggtggaaggggtcattagggttcccctgagttctagcaggaacattccccagagttctagcaggaactatagaattcgttagtcctcagactggtctatagccctcatcattgttcacgtcaaaaccagcatgttgagacttgtattcatttgaaaaaaggaattgagggtttggcggcctttattttaacctgaccaagtgagggaatgctcaggcccttttgctctggtgccatagggcggggctgggcgggccaggcaggaggtgtggcatgggagacctgctccccagggcctggcctggggctggctgtacagaaacacagactacatctcaaggaccccaggagcttgcagtcccaacagcagaatgttattcatgttctttttatttttgcgtttgtccagaagcactaccacaggaagagcaagaaggaagtggaagtgaggagagaggaggtacaggccattctctgccgctgttcttagagaccccagcgttgaggcacccttgcttgctggtcttttccccagtcactgccagggagccccctaccccgggagatggcggatgcgtcccccgatcagggagcaggcctcgggatgcacaggaggctccacgctctccaccagccccacgggcacccagccagccctctcttgccagcttctctccagctgccctgtgactccccatctgagagaagacattgtggatcattgtcatcagcttaggtccaaccactgcagcaatttagggaaaacctgtggctgttctgggtttttttcccatgaccaccttcccaaacgccagggtgttttatgatagggccctggtaactccatgccagaaaacacccaactcttyctctccctgctgtcagcccgcagccgtctcacatgacaaagattaatctctttcctcctaacctgcagaggagaaggggaccagctctccggactatcggcactaccttcgaatgtgggccaaggagaaagaggctcagaaggagacgattaaggatcttcccaagatgaaccaggtaggctccactggagcccacagtagacatttctggagagttctgaccaagactgggccctaacatcacyrcacctgcactgcagcatctcctggtgggtgggaaggctcctccctgcctctagagcccgttagtcctggttgccagtcagcgatgattccagaaagacaagaggccagttgctccagggccttgtataggggcatgtttccagattgagtgagtgtstgtgaaccaggagccrgaggcttgtaggctacctttgacaagatatgcgttccacaccctgcaccctcccagccctgcccagggctctgcacacgcaggctcacatgcatcctccacacccgctcttcattcactggtctcgcagatcagaagcatggtgtcttgccaagggtctcaaagccagaaaatgggagaccccagctccaaactgcaagcgttgagccaaaggcaagtctggagcaccagcctgaccatggccctcgggccagacccacggtctagctgtgcccagtaggggaccctgcaatctgaccactcccccagcaggcctggagggtgggcaccacgtgcgatgaggattcttcccattcttgggccaggaggcctagacgtgtggcttcaggacctagcacccaccctccccagcacccccctccccaggatccccctccccagctgacccaggctgtattttcctcaccatcaccttctaaagagcttcattcaagggctgagttgaggctgcttctgattaaaaccaaaggtgattctaaaacacaacgaagtccttgtactgactggatttagagtcgtggtagaaatccatctccctgtgccaacagaacggacctagaaacagggaggccccaggtcagaccagcatgctctgagtgccaagagaaaggcagctggaggggaaagccttttgaagagctgtgtggcctctctgagcctgtgtcctgatcngtgagatgggactgatgaggctcatggagatgattagcaagacggcagccaacatccttaggctggtgcttgtcatcagtttggctaatatggaccccgtctgactggtcttttaccatctccctgttcttctgtttttctccctaaaaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgyaggagacccccaagccaaagcaggcggagacacacacctcggaanagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattasaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcangtgcttgttgggcaccaaagtgatggaaccctcaggtgctctccgggagcctgaacctcctgactgaggaacatgggcagaacatgtttattgcacagagtgggcgctgcgyacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggcyctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagamccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaagttgtaaatgtggtctgtctcacaatatcttcttgtactgtactcatctcttttccaggtggctgttgactctgggtaactaaagctgcagaaggtgaaactcaggtactattgtatatctctgtggctgctgtttttgttttaattaagtagctttgtttttttgtttttttgttttttttgagaccaagtcttgctctgttgcccagcatggagtgcagtggcgtgatctcagctcactgcaacctctgcctcctgggttcaagcaattcttctgcctcagcctcccaagcagctgggactacaggcgtgcaccaccacgcccagctaatttttctatttttactagagatggggtttcaccatattggccaggctggtctcaaactcctgacctcgtgatccacccgcctcggcctcccaacatgctgggattacaggcgtgagccaccatgcccggtctgcttgtttgtttgttttagagacagactggagtgctgtggcatgaccatagctcatggcagcctcaaactcttggcctgaagtaatcctcctgccccagcctccctagtagctgggactacaggcatgaaccagcatgcctggcttcaatttcctttctagtatttacacaaagtaccataaaataatttcaaatgatttataccaaaaagaccattgttggccttaatataattaagatataataaccccacatatttggcaattttaagtcttacactgattatattcaattagatttgaataacttggaatttggataaatggctttttatttcccattttttgtctttacagaggtaagataaatgtttttaatatatggaagtataagcttgtgaatacaccaaagaaattaaccaaagaataggaaagaggaatctggcctattcacgtgatacaatgtacgaaaatgtacaatagtactttaatccataaatcattcaacctgggaagataactcaaaatgtttaacaaccagaacagtaacattaaataatatatagataatacaaataaaaaatttaaattttataagtaaacatgaatattttaaaactgcttaccaagtaatataagttgcatcaaaccactcatcaaatcattcttataatttccaagaaaaaaaactatatacatgaatttttaaaggattaccggttcattgccaaaaggagaaaaatatacagaaaagtagaacaatttttcctagtgctacagattactcagtattttggtgtttattctgtattttttttcagagtttaactgatgtcatatatgaaatttttattctactcctttcattaagcataaaacattttttgcagatgctttctgttctcagccacagtagctcaaacgtagaaatgaaggaaaaccacccaaatgagaaacagtattcagagcttgctacagcaagggagtcagcaacatccccggtgtgggtaggcgcaaggacgcagggggtggaaaacggggaaggctccaggtggttctgaccgcaggctgttggaaactggaggtgagctaacaagaagcaggatgttttctgtgactggtttggggagcgctttcttgggttggttctgacatggggagggtggtacaaaaaatagaggagcaagcagtcctgaccacgtccttcccaagcagccgactgcccggttactgcagaggctgcagtcagtttattgtcattcgttatctgaccattgtctattggcatattgtctctcaatttttttttctaactacttactgtacaaaagttggaaaaatttaaaaattagcattacctacgaccttagccacacacacacacacacacgccagaaaataatgccggtgtcacagaagtcaaacgatgtactgtaattctgtaaccttgcctctccacagcacgttgtcacttcaaactcaggttcttgctgatggaactgcctaagagtccgtgccgttcttcagaacactgatttccatttcttcctagtattcttcagggaacactagggaatgaataataaatcacctaggtgaagggattcctttcttggggtagcagtattgccaggttgctttccacggttttgcacttgaccgttctcccagcaccctgtcagaggggtagccctccctgcacccttgtcaggattgggtgttttcttcaacgggatggtttctgctgttaaaagcgagtgtcggccgggtgcagtggctcacgtctgtaatcccagtactttgggaagccgaggcgggtggatcacctgaggtcaggagttcgagaccagcctggccaacatggagaaacaccgtctctactaaaaatacaaaaattagctgggcgtggtggcgggcatccgtaatcccagctactggagaggctgaggcaggagaatcacgccactgcactccagcctgggcgactgagcgagactgtctccaaaaacaaaaaacaaaaaaaaaacacctcgcttttttggtgatagtcactgtgtaaaagttggaaaaaaaattaaaattacaaccctagacaccgagggttgtacggtgggaggtaattttaatattttttgtattttattttccaacgaggttacaaccctaagccacacagggttgcggcgtgagcgtcgggctgcgggggcgcctccaccctccgtagggtgggcctgggacgctcccggggctgcagggggaccggcttcgcgctcggcggccgcgcgcctccgccgccctctccgggaagcgtgggtgtggtgagcccctccgtctccccgtattccaccccgggctccggttcaaaggctaactgttcgctgctacctaaaagcacggcagcgcaggcctggcagggcggcccctcagccccgctccgcgttgtgtccaaggactggtcagcggaggccctgtcgtctcaattccagtctccccagggccggaaccagtgccttaggaagatgcgggcacggccctggtcagacgacgagtcggctaccaggaatcccgcacccaggactctttccgaggtcggaggggcgcagatgaccagcgagaggcgcggcaggctagagggatcccagtgcgcaggggcggggccgcggcggccggagcgaagagtataagcgcatgcgagacggcgtaggggactagagggttcggagcgcgtgcgtggggcggggccgcggcgggacaaatgcagagcgcacgcgcttggctgcctggcgactgcacaagcagggatggcgtcgcttcagcgttctcgggtgctacgctgctgcagctgccgcctcttccaggcgcaccaggtctggcgggtgccagccccctcctcctcctccggcgcggggacagcggacggggagtggcggggctgtgggtgttgtctcgaatggctccgggatgcaccgggcccgaaggagtgcagggaccgctgagggcgggtctcattggggtcgcccccgcataacgttctgagctttttgtttggttcttgtacaaaccagaggtaatggttctgcggaggtggcctcttgtgaattgtagcaggtagtgggagaatccggttgagtatagcatcctttacgcagagcctaccccacgaagtagcgctgtcgcagtttcagtgagagggggaggacggttcttagagaccgagcgcgccgcggcggcgtccctgctccacacctgggcgccctctccgtcgccccgcgcctctgccgccgtccgtttccgcggggccagagacttgatatggctgttcgccgacgcataaaccacgggccccggagtcttaaagacagataatctgtgtttctaggacatatttgcctccctaactttcagcgtgccagatagagaatgccacttaaccttttccggatcgcacctgtctccctgcttgatatcacttaacactgcagtcaccgtatctgcttctgatagtccctccctcctaattattggtaatctgctatgccctgagaaagaatagcatcagacttcttcttcttttttttttttttttgagacggagtttcgctcttgttgcccaggctggagtgcaatggcgcgatctcggctcaccgcaacctccgcctcccaggttcaagcaattctcctgcctcagcctcccgagtagctggattacaggcatgcgccaccatgcccagctaattttgtgtttttaatagagacagggtttctccatgttggtcaggccggtctcgaactcctgacctcaggtgacccgcctgcctcggcctcccaaagtgctgggattacaggcgagagccattgtgcccggcgtggatcagacttgtttaagaggtatgttaaaaagtcagcaagatgctgagtatgtgtctgtaagcttgcatttaatgctaagcgtttgtaagggccattttaagggctcagaaactttttacttattttctttcgggagctgggtcctaagagttgcaaataaagggagatcatttgcatttttaaattattccacgtctaatgtttcatgctgttttttaaaaacaaattttccgtttatttttatttcctttttttgtttttgagacagagtctcacgtctcactctgtcgccaggctggagtgcagtagcgtgatctcggctcactgcaacctccgcctcctgggttcaagcgattctcctgcttcagcctcccgaatagcttggattacaggcgcgcgccaccaagcccagttaatttttgtatttttagtagagacggggtttcaccatgttgaccaggaaggtctccatctcttgacctcgtgatctgcccgcctcggcctccgaaagtgctgggattacagtgctggtgttacgggtgtgagccactgcgcccggcctctatttccttgtttgttttcctgtttcactcttccatgttcaccagtgttatttatttatttatttacttatttattttgagacaaggtctcgctttgtcgcccagattggagtgcagtggtaacaatcacagctcgctgcaacctgcatctcccgggctcagctgatccacctcagcctcccacgtagctggtactacaggtgtgggccaccatccccagctaatttttatattttttgtaggaatgaggtttcggccgtgttgcccaggctggtctggaactcctgggctcaagtgttcttcccgccttagctcccaaagtgccgggactacgggtgtgagccagcgcccctgaccctcgtggtcattttcaaccttatgaaatgtgagttgcttggccccggtggctcacgcccataatctcagcactttgggaagcccactagggcagatcacttgagctcagaagttccagagcagcctgggcaacgtagcgagaccttgtctctactaaaattcaaaataaaatagctagatgtagtggcgcgcatctgtagtcctagctactcagggtcgctgaggcaggagaatcgcttcagtccaggaggtagaggttgcagtgagccgtgttcacaccactgcactccagcctgggcgacagccagaccctgtctcaaaaacaaagaaaaattacttgaaaccaaagaggacggcaagtcggctatgtactactttaattttaattgcaagtcggctgtgtactactttaacacgtttaacttcaacaacctttgacttaggcatcattcccatcttagagacatgagaattccgaaatacacgggaatcaagtggtttctccatctagggagtggcagaaccatactatctcagcagttcccacaattaattcctttaccaggttctgtgagtcctaaacttttaaaaaggcttttcttggccgggtgcggtggctcacacctgtaatcccagcactttgggaggccgaggggggcagatcatgaggtcaggagttcgagaccagcctgggcaatgttgtgaaaccccgtctctactaaaaatacaaaaaatacaggtcgtggtgg

SEQ ID NO: 10771 - DNA, 12785 bp, Homo sapiens
  misc_feature (1)...(12785): n = A,T,C or G, or insertion/deletion polymorphism (see Tables 1-2)
gtaaaattaccaaaatgactgtaaaatagaaaacattgaaaatatggattttactctcttttagcaactgaattacctgagagtggttagggttacaagggcaatgtcaatggaatataaaaagatatacaaaattagaaaacaccagtttattcatgatcccttcagaccacaggtgccttaatattcaaagcatcctcttacagtgactcaaattccagaggaaccagccattactacactaaaaaaaaaaaaaaacaaacaaacaaacaaaaaaaaaacaatgacaggccaggtgccgtggttcacacctgtaatcccagcactttgggaggctgaggcaggtggactgcttcaggccaagagttcgagaccagcctagccaacatggtgaaactatgtctctactaaaaatacaaaaattagccaggtatggtgatgcacgcctgtaagcccagctgcttgggaggctgaggcatgagaattgcttgaacccgggaggtggaggttgcactgagcctgagatcatgccactgcactccagactgggcaacagaatgagactctgtctcaaaaaaagcaaaacaaacaaaaaggcaatgacaaaaagtgtcagtacatacaataagtaatataacattatcataacgagttagaaaaaaatttgtaatgctctcagtttgacttaagaactgaaaacacaaactgacaggttgtatctttcaatagataactgactaaaaataaaattggtgtcattttgcagcatcagagaaataggttaacttatgtatacaattttttttttttgagacggaatcttgctcttgtcgtccaggctggagtgcaatgatgcaatctcggctcatggcaacctccgcctcccaggttcaagcaattctcctgcctcagcctcccaagtagctgggattacaggcgcccaccaccacacccagctaagttttgtatttttagtagagacagggtttcaccacattgtccaggctggtctcgaacccctgacctcaggtgttccaggtgatccacccaccttggcctcccaaagtcctgggattacaggtgtgagccactgcacttggcctcttttcttcttaaattaccctggattattccaacagtcatgcagtggtctctctacctcgatccttgcctttttctgcaggcgttctcaatggagtagttagagttcagtcgcctcggcctccgaaagtgctgggattacaggcgtgagccaccacatccagctatgtatacaaatttttaaaagaattggatcttttgttttcttttaaagatctctatcccacagaactaaagctagtttagggtggaactcatccgccagaggggctccttacaaaagaggagaaataaaatgttaacagaaatcaatagtataaaacaattgaaggttagaatagactttacaaaacaaaatcctttaagtccataaattccacacaatcacaagcaaaattttgtctatgttatttttctaggaagcacaagttttgttattgcagtgagtcactagactcatttgctcaggtgcccataaactgatcaaaaacatacaaaagaggccaggcacagtggctcacacctataatcacagcactttgggaggccaaggtgggaggattacctgaggtcaggagtttgagattaacctggccaacatggtgaaatcccatctctactaaaaatacaaaaattagccaggcagggtggtgggtgcctgtaatcccagctattagggaggatgaggcaagagaattgcttgaacccggcaggcggaggttgcagtgagccgagatcatgccactgcactccagcctgggcaacaagagcgaaactccatctcaaaaaaaaaaaaaaaaaaaattagctgggtgtggtggtgggccccatcaatcccagctactcgggaggctgaggcagtagaatcgcttgaactcgggaggcagagactgcagtgagctgagattgtgccattgcactccagcctgggcaacaagtgtgaaactctgtctcaaaaaagaaaaaaacaaacaaacaaaaacatatgaaaaagctgcaattagtcacccatagcaactcaaccagggaaataatatttatcccttccactccaccccacactagttagtttgttctaggactgtttaaaagtcctagttctatgactctttttggggtcctgaaacagccacctaattctgggtttagtgactctacgaaagcccatgtcatcaccgttcttggcttccctattacctcctaccatctagctgtaagtattttctacatgacttcgtatatcttaaggccagtaaaattaaatttataatgaaactacattagtggctacttattcatgagaaatgtatcatttttgaaaacaatatttattaataaatgtagactatctcatgtaaatctcacaacagccccatgaggcagttactattattatccccactttacagatgagggcactgaggtttaaaagtctcactgctaggccgcgggcggtggctcacacctgtaatcccagcactttgggaggccgaggtgggcggatcatgaggtcaggatttcgagaccaacctggctaatatggtgaaaccccgtctctactaaaaatacaaaaattagccaggtgtggtggtgggcacctgtaatcccagctactcgggaggctgaggcaggagaatagcttgaaccgaggaggcagaggttcagtgagccaagaccatgccactgcactccagcctgggcgacggagcgagactccgactccaaaaaaaataaaacataaaaaaaaaaaagtctcactgctagtaaagagcaggtcacaaaccactgcactacaccacagacaagaaaataaacatgagccaggcacagtggctcacacctgtaatcccagcacttcaggaggctgagacagaaggattgcttcagtccaggagttcaagaccagcctgaacaacatagtaagattctgtctccactaaaaatttttaaaaatcagtggggtgtactggcatatgcctgtggtcccagctacttgggaagctcaggtggcaagatcgcttgagcctgggaggttgaagctacagtgagctatgattgcatcactgcattctagcctaggtgacagagcaagaccatgtctcaaaaaaaaaaggaaaagaaaagaaaaaagaaacatgatctaaatgtccagaattcaaaaggaatcaagcagtgagcttaaaggtaattcctaatatacagttattacctaaccaacagaaaggaatttataataactgtatatttgttgagttcttcatagagaataaatgagtaggttgacaagtaggacattatgatgaataagggttcagcaatccccatatgttgagttagcaaaatttctaagaactgacaaaactttcattcacctgcaagtctatattaaacgaaattagtggcatatatttgataagttccaacatatttctgtgtgttaaataaatgtgtttggactacattacttttttttttttttgagatggagtttcgctcttgttgcctaggctggagtgcaatggcgcaatctgagctcgctgcaacctctgcctcccgggttcaagcaattctcctgcctcagcctaccaagtagctgggattacaggtacacatcaccactcccagctaatttttatatttagtagagatggagtttcactatgttggtcaggctggtcttgaactcctgacctcaggtaatacacctgcctcagcctcccaaagtgctgggattacaggcgtgagccactatgcccagccttggactacattaattttaaggcccccttatgcaataaaactccatgattattagacaaaccgaattatgtaacttttatcttctagttttatctaattataaagtaaattcctgcctcttaaactgttatttctaattatttaaacattaataacatgattaaatcctacacctgaaatacatatacaacctattgtagttctaaaacgttatattttggggtttggtatctttgtactgtgattctacaatgtactacagtagtaatttttgtctgttcaaaagatatttccattatccctttcagaatacaaatcctgctcctccatgatctgggcatgtgacctatgctgaccaattataatatcctactaccctaaacacagagatttattcaaagataagcatgtgacaaaagcagaacctttcctgaaattaatatgctgacactacaaaaaaaaaataagttctactagggttctaaacagaatggatataggcttggactgttgatgtcttccttgccagctatgaggaaaaagtctacagtaggaacttaataaactgaagccaagtaaagacaagcaaaaatgaaagaaaagagtgaaccaaagtcctgatgaaatccatgtggaccttgaatctattccagccttccaggttaaaatagccaatgcatggaatttttgcttaagcttgtttatatggctttctgacattcgcaaacaaaaagtctctattgaactaagctggagatgacaggtttcaacatgagtaccaacactcaatattggcagtgactgcctacagcactgagatgagagagactgagatctcctccggggacgaatgcaatgatctagcaacggtatctgccatgaataaggcagcacatgccacatacttgtcagcctttggctgagcagtgtcttaggaaatgacactggcatataaaagcaaaaagcagtaaaaagagcccaggaagccaaagcagagtgggaaaaattgcatcagggaaaagaaaaaaagtcacaaaaaaatggcaaatcaaaataaaattggcttgattcagaacacattttaatgttccaattactctctagtgtaatactttaagaaaaacactgatccacttcaagctcattctctgtattctttctttttgcttaaatatactctggatcatttgtgacccagggaaaaaaggttatcgttcatcagtttaggttcacatttaaggtcaagtccccctggtttaaaggcattctcaaaattaaaatttatgtcaacatatctacacttagttctagtctaatttttccaaagcatgtgacttgatttgtgatccaggatcaaaaatcccagaactgaatcccatttctgccatgtactagcttagacaaatctctcaacattacctctgaacatttccctcatctgtaaaatgagaataatagtacatacttcaaaaagttgctgaaaatcaaagtgtgcctacaaagtggttggcatggtacatggcacacagtaagagctcactaaacattaaccataattatttagcattcacttaaaaaattttctaatagccactccattccaaccttcttaacaccctaatcttgccattaaatgcccatttgttcattcatttaacaaaaatatatactgcttacaaatagagaaaatagatgaatcaaatacagaactttttcacaagtacaaactattaagatttaatggtagacagcaacaaggcaagaaagaaatatataagttctctggcacttttgatggagaaagatatcattaaagataataaccgggctctttaaagagttcattcattcaacacatgatgaatgaatgtggtaaagatgtggtgtaggaaagtagtggaatacagcattttctagagtaaggattaaggacaactaaagtactaaaggaaaaaaggaagcatgtatgtgaaacagcaagcagttcaggttggcctcagtgaaggtacttgaataggagtaaaagaaagttaagactgccctctcccttcttgacccctatcctttctcaccctccctccttccctcctgtcgccatcacttctggcaccgctgcacccataggagctccccagtggtgatgggttctcagccctccatgttactgtgggatgaagagcttgaggagataaagaagatcagtttttcccacagtcaaatcacttgctctacagccggttcaccagcctggacaaaggagagatggcattctcagccatgaagatttcctgaggattccagaacttgtcatcaacccactgggggaccgaatcatcaatgtcttctttccagagggagaggaccaggtaaacttccatggattcatgtgaactttggctcatttccaccccattgaggataatgaaaagagcaaagatgtgaatggacccgaaccactcaacagccgaagcaacaaactgcagtttgcttttcgactatatgatttcgataaagatgataagctctcccgtggtgagctgatacaggtgctacacttaatggtcagagtaaatatctcagatgagcagctcggcagcatcgcagacaggaccattcaagaggctgatcaggatggggacagtgccatatctctcacagaatttgttaaggttttggagaaggtggatgtagaacagaaaatgagcatccaatttcttcactaaaggacagagaccaaactgttccttgcggtctagtatttaataactggaacttgaaagtcctccttctaccaaccccacctccaaccnatcattccccttctcccaaagtactactgctgttgcacgacaaccccaaatatgttctgtcaacacaaacctgcctttgatgcataaacagggcattacagaatggtacacccagtctatttctgttcagtatccagtcactagttcttcatttataagtatctttttccccattctgctgctgaatgcatatccatacagtctgagaaagtgagagacggaatcatgccaagaacaagccagcaaagctctttcaccagatgtagactgtagccctactgccttccctctagcaagtatgccaccatgcttcttcatccttttcatatgtcctttgcttcctacttctgtgtcatccaacatactgtttgcttagtctggcagtctttctgcttttcagtaagcctcaaaatctaatctgttctacttggcactgctatgccctatgtattcctgacttgacaggatagttcaggggtctggcagtttttatttaccttcattattaaatgggcctctgggatgttgcctctccaggagctttttggtaaccaacacttctctgagaagtatgacactatcctctgcattctactctgtcatcaaagggctgctgggtggagatactcatcttgaaaggtggccttggtgagaggtgtggagacaagtcttctgggttgcttgcccacatcactctacctctggcctctgattctcaacttttacctacatggctcctcgttagtgcagtgttgactgttcaaaaaatagcaatatgcctatgggtttgtttagtttggggacaccgttaccaccagaatgactgctctggcaatatgcctggggactttttcatggctttttatcaaggcagctggacaccctataaagcctcacgcattcacacctttgcagcatggtttatgacttagtgttacgtgcactggaatgtttttcacttcacatttccaagtagaaagattagcgttaacttatcccagtccaaaacatttaaagattgtttcctccgtatcttgaagttttgcacaaaattcttttttatttttttaagacggagtcttactctgtcacccaggctggagtgcaatggcgcaatcttggctcactgcaacctccgcctctgggttcaagcaattctcccgcctcagcctcccaagtagctgggattacagatgtgcaccaccaaacctggctaatttttgtattttcagtagagggtttcaccatgttggccaggttggtcttgaactcctgacctcaggtgatcctcctgcctcagcgtcccaaagtgctgggattacaggtgtgaaccaccatgctcagtcacaaaattctttatgaattttacacttggcaaatgttaatgatggaagccatagtcagctcctaatacatgtccaaagcattgactattgtatcattagctgcctggttacactagcttcctacttccttgtatagaccactgctaatcccttaaaaatgaggtctggcactagtagcacaacctaaggtggcattacaggtcttcgaacaagccacagcaacttttctgccaaagtcagcttagtttagacttcagtgaatcaagctattgccatcctaatgtatgtccctatgagtctatttatccaaacatctgcccttggctgactttctctgattcactgcttgcgtgcttgtttccttgctttggaaaactattgaagatgtgtacataattatttaggaaggggattgctaaaaaaaataccactgcaaagtgatggaaaagggtagagaacagggaagtagctgggctggatggctcaaatataaatgaatgagaaattcttcatgaagtatcagtcagactttgtgatcaagtgaaaacggaagaatgtctgacactgatctatagagaggtacttcagaggctccttgatttgcatatctaaagttcctaaggttatagctttcccctcttttggctgtatagcaaactgttttaatccacggttgtgccttattgttccattaaaatatatcaataaacacttgtggttgaaacaaaaaaaaaaaaaaagaagaaagttaagactaaaatctggtcagctcgagatccttaaaggctctgaaaccaagtccagaatcccactttcattctgtcaacgtgaaaatttaaagatttgtaagtggtacaattataagttcataactgtataggcaaaagatgagtgtgctataacatgtaaaatagattggagaagaaacgtctgctgtaccagtatgaaatctgcaaattaattaggcagctagagaaaacatgaaaagaaagtctgaagggaaaaatactaatacaattgaatcagtaagattaaaaatttaatgaaatttgggaagaagaaattaaagatgatttaggtttcaagccttaggtctatgaactgcactgaggaaatatggttcccaaacttcacagatctcttacccattttctggaatgccatatcatattttaacttctttaatgcactaaattatttttacttatggagtgaaacatgtatcttgcaagaacatgatatagtaactaataaatagattaaagaaatctggaggactgtaagtatgctgagcagggaagggaatggggtacttattacatttgatacatcataacatgccaattaaaagtagaatttgaacttctgtaatcattttttcataaaaataggagccaggattcctatatccatttgttcactggtgtatccccaaatttctagaatggggtctggtatattgttagaactcaataaatatatttgttaaatgtatatataaatgagaaaagaaagaagttattaaattttaagaaaggttctacgttggtctcaatgttctgagcgttcaatattctctcccaatctttcttttattaaaatagccttctgtaggtgactctattttgaaaaatctaaaactgtgacagatttagtaaaatgttataataaccactttaaataatactaaattattgtattaaccactaaaagccaaaacaaaaatcttaatgtatcatcagacataaaaatagtaatatctgagattttatacaaatttttaggtatactccattttttgggttggctccatttcacagtttggaaatatttttaacttcagatatgtgatataaagttaaaattaccccttacccacatgatcttcaaggcaaatatgttagttactatatgggaaaatttaaaatgtttccttgcagagtttatcatcttaccaggtctttccttcccagtgccttttgactcagcaaatttttgtatcaaactttcaactgtagtattagccatgttatttataaattcttcatggacctattaaaatgaaataaagataactttttctttttccacattcttagtgtatttcagataaaacttacacaagacaattaaaattaattatatcaaaatatgtatttttgacccaaggccctttgaggactttaatttacctaacttccagcattactggatctgtagggaccaaccatgacttacattaaccccttaacacatagcctcacgcccctagaagtcaaagcagttttctgttcccatctttgagcgttctagagacatcattcttatgataagacttatacagacaacaaaaatacttttggcttaaaaaaaacacacacacagtctgactctgtcacccagatggctgggtgtcacggctcactgcagcctcaacctcctggactcaagtgatcctcccacctcagcctcccaagtagctgggactataggcatgcaccaccacacccaaaaattttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatcttttttaatatttaaacaatttaaaatattttttaatatttaaacaatttaaaatattttttaaattttgtgtagagatgaggtctccctatgttgcccaggctggtctcaaacttctgggctcaagtaatcttcctgccttggcctcccaaactgctgagattacaggtatgagccaccgtgcctggctagtttgaagaataacagacttcatctttctctactatatttcagtataccccaaattgtcatcattaaaccttttatatttgtggaacacttctaagtaaaagttctatagtttaataaagttgctgctttaaatttaaaaatagtaaagcttgaaaaaagaaatattcaaaagttgatagctttagaaattcaatataaagaaaactgaatatagttaatttaaaaaattaatttgaattatcatcctcggtggccaaatgataaaatatccagtttattttctatttactacatgtaaatatattatctttacatattctttatttggaaaaattcggtattatacttatgaactttgaacagagtgagaaaatatttttaaagagctataaataaacaaatttttcatgaatagttcaacataaagtaaaaaaacttacctggcctatctgcaaatgaatttcctttatagcatttgacaaggatcctataatttcctttatgtgaatgagatgagtttcttcaatatcttgaaatttctgggtaacatatacaaagttatagatttataacatatacaggtacatacatatatattctggaatcaaaagagctttcagaaatcatctctcccagcactttgggaggctgaggcaggtggatcacttgaggtcagaagttcaagaccagcctggccaacatggtgaaaccctgtctctactaaaaatacaaaaattagccaggcatggtggcagatgcctgtaatcccagcaattcaggaggctgaggcaggagaatcatttgaacctgggaggcagaggttccagtgagcccagatcacgccactgcactggagcctgggcgacagagcgagactccgtctccaaaaaaaaaaaagaaatcaactcaatataaccaaattttccaagttaccacttttacacaatgtttaaccaagcctcaagacagacagatctagcaggtaaactgaaatatggcactgcaaaaagttaactttttgttatgtcatttcttaggtaaatacaaacttttctagaatttggagcttttttttttttttttttttttgagacggagtcttgctctgtcacccaggctggagtgcagtggcaccatcttggctcactggaagctccgcctcccaggttcacatcattctcctgcttcagccacccgagtagcttggactacaggtgcccaccaccatgctggctaattttttgtatttttagtagagacgggtttcaccgtgttagccaggaaagtctcgatctcctgacctcatgatccacctgcctcagcctccaaaagtgctgggatacaggcgtgagccaccgcacccagccgaatttggagccattacacattaaaatctataatcgtgatcagaaaattaggagacccagaagagaataatgttacaaaaaaaacaaagagttttaaaaactgaaaaacaatcagttggcaaagcaaaaactacagtttactttcaaatgctttataatctagcccatagattttcaaaatgtctttctaatccttgaaataataatatacaccgggcacggtggctcacacctataatcccagcactatgggaggcagaggtgggcagatcacaaggtcaggagtttgagatcagcctgacaaacgtggtgaaacctcgtctctactca

SEQ ID NO: 10772 - DNA, 42548 bp, Homo sapiens
ggccgcgcacacctggctaatttttgtactgttagtagagacagggtttcatcatgttggtcaggctggtctcaaactcctgaccttgtgatcctcccgcctcagcctcccaaagtgctgggattacaggcgtaagccactgcacctggctatttttttttttttttttttttgagacaggtctcactctggagtgcatggctcactgcagccttgacctcctgggctcaagcaatccttccacctcagcatctttagtagctgtgaccacaggcacacatcaacacacacccggctaatttttcattttttgtagagatgaggttgttgcccaggctggtctcaaactcctgagctcaggcaatcctactgccttggactcccaaagtgctgggattatgggtgtgcactaccacgcccagccaaggcttagacattttagaatgaggcgatcctgatttcagttctaccagagtcatgaccccactatgctgctgatgaagactggggacaaaggtgttgaatggtacaggaaacaggagtcttaccagggtcatgctgagtgtacggcccatgacagcatggaacaggtcgtgtgcagctgggccagacacaacaaaaaattcacagatgaaaaggtattcgcggcaggaattgtctaggagggcgtagtgctggctgcggaagagggcctcaaatggatactgggagaggaggagtaaagaagaaaaacagaagggatggaccccaacactgacttcccatggatatggctggaaaatcagtaaacctgagtaataagagctaggcagacccttcgcatctatctaggtccgggctgtctaagagcaagctgaatgggcactgaaaaggtgggggaacataggggtacaaaaagggcctacacccacctgctgttgctactcctgcatccacctcaacacctgcctctgactgtcattcccctcatccagtctctcccctctgcatgcccttaagtcaatggttcccagctcttttcacatcacagcaggctggagtgattggagaaggccactcccaagtctaaggggattaagacagggcctgcaggttgggaagctctgccctgaggtctggccttccctccccaccgtgctcagagcctctttcgtgactgaagcttgttcctcctcataccctctgctctccgcgctgcgctgtgtgaggcaccaggatgggggcctcaagttcagtgggggagatgacagagccgcgggttcctagggtgaaaatggtgttcctgctgcggagcgatggctttgagaagaatcgtaagatgggtcagagtcagggaaaacaatgagaccataactgggcccaaagactcactatctgtggggaccccagacaggcagacgtggcctagccagccctctttcccagtactagggccccacgtgctgacatctgtgaatgggcttcagggtgtctctccctcccttgcaatcatatgcaaaactatgtgtcaaaataatgtgtgcatctttctggggagggaggctatagctttcatcacattctaaaaggtttcagtcccataggaaaaggtaaggagcagtgcattggtggctggagtcgaaagtcctcccactctcaaggcctggcatgagggttccccagtactaggatatctttctttgctgtatcttccacacccattagatcatctttctcagcgacttcctcatactaaggaaagagaaaagagaactgataaccgtctcttcccacaacacaataaaatattccttgcccagggatgtcccctcctcccagtccatgtgcccaggaatacctctccctcctgaccttacctgcaccttcatgagccgccccaggtaagagcggtagtaagacaggtaaatcttgctcagcgtctccacatattcatccctgatctcctttgctgttgctcgttcattgcccagcagaaactgatagaagaacctagggggtcaggaacatgtcagtctacctgtctcccaagaaaccagatgcccacactaggccgctcaaaaactcaaaggccatcccatgcacttccttggggttgtgacctgtacttcagcagggccgtctgggggatctgatagttggtcatgggtttcctgaaggaataaatcttctggaggataaactctcggatcttcgtcactgcctagatgtggggaaccaaacacagggcatgaagctgcaacccttttgctgtatgagaggaactgggggaagcaacaaatggtaaacataggcagaagggtggtgaatatctctttggtatttctcaagattttcagggaaacccagagagacaagaatggggctgcccagaaaaggcagggtgaagtccctggagacaggctacagtgagctctgccaaggaaatccatagtgaagatcttgggaaggctgcttccagtagcctccagggtatccatccctacttcccaccttgacccggagccgatcgagcacgcctctgacatctgcgcaggctgctgtgcctctagcttcctgctctctgactgcggctgccttggcatccagctcctgtagctgctccaagaacctgggctctgtcactggagcctccagaattgccctggttagcagggaggggtgggatgagttacaagggagacccagacatccctaaaccagacccagaccacactccttacctccagcccctgtcatctctaccaccttgcattgtaccatatagtcaggacacatgtacaaagttttctattcctggacctccccactatacacctgatcttacatcattcttaatcttaatctttgatgcctaatgcatacctaaagaaatggtggttaacctggctactaatttctaaaaagcacttaacctggagccaggagacccatatggtaaatagggtgggtcaccccagcccatccacctgctatggacattataacccttcaaactggtaactcacgtgaccagagcagaaggcaccaccagaccatcaacaagctccccaagtttcccccgaactgcctggcgatttcgaagtcgaatgttcatggctcctgactgttcctgcagtgtccggatctcagagctgatggagctgaggtcactctgaaaagctcccaacatctgctccattcgctgtagggagggtagatgttgccggagtgctatagggtttgtaggggataagtgggccaccaaagactctttgtgaagtcttcagtatttatcagtccttgagggtggcagatgatgagacaccccagattatcaggaaataacattaaatatggcagtaataacaaaaaaggctcctgaagtcatcttgaaaatgaccctaacctgtccccatcttgaggctgatgacctaaaaatggcaccagagtccatgatctggttcagagtagctattaggggtcacaggtcatgattactaacctccaggacagcatcacaggctgtgatctggttgtgtagagatgctatattctcactctcttgaatatctgatccacaaaaagtcaaggggcctcatggtgaagatgggagatcctcagatttgtagtacctctccaatttctctttgaagtgatagaaacctcagagatgttgaccccagctgggacatctgtaccacacgccacaaaatccccatgtcaatagcaccaccccttccctctgctggaggatacaatcccgaatggatttctgttcaatctgctgtagctccagctcaacttgctttgaatagtgacggagatctacaccctgggagaacataaagatgacaggtcagaaggaagtctcagtaaagggacactgtaacagaatcagtgaaggactaaagggtcagataccaggctgatacaacaaaagcaagagactgttgtttttccttttggggtagaatagatagaagggcagattagtacaggggaaagcctcaccgttttaagagcttcctttactaactcatcctccagatttgcctgaatgtgaactggaaatagaagtttatcataagggtccagctccacagctccctctccccacattgagtatctgcacaccaatccctaccttattccttccagcccccatgcctctcagattacaggtactgcacccaccccatgccatcgcttaccatccacttcatccaggatgaattcatcagaagtgatatccaactccccaagttgcagtggttcctggagcccaggaccacccgcctggaaagggataagttaatgggagtagggtacggtgaaagacagaaagaaaaaatataattggatatccccagtccttcaagtgagaaggagctgcttttactgggagccacaggtactgctttgaaaaattctaagagtctcacgttgtacccactctcctattttgtgctgatgggtaaggaatacgacaaggagtgagacgatccagtgagacagtggaggtagcccagcatggtggtgggctccttgtagtcccaactacttagaagctgagacgggaagattgtttgaggagatcaggagttcaaggtcaacctgggtaacacagggaaacccgtctaaagaaaacaaaaaaaggtaaaagacaagacagtgcagtggaggccggacgcagtggctcacgcctgtaatcccagcactttgggaggccgaggtgggaagatcacgaggtcaggagatcgagaccatcctggctaacacagtgaaaccccgtctctactaaaaaatacaaaaaattagccgggcgcggtggcgggcgcctgtagtcccagctacttgggaggttgaggcaggagaatggcgtgaacccggaaggtggagcttgcagtgagccaagatcgcgccactgcactccagcctgggcgacagagcaagactccgtctcaaaaaaaaaagtgcagtggagatgaccgaatgaggaaagctaggaattgcagaggatagagcagaacttgcacttaaatttaagaccctcagactcctgccatcttgggtgttctatcacacctctggggaaccccaggctttctagaaatgtcaaaacacatagtgtttacctgcatgccaggtgcaatcttacacatattcatctaatcctaacgacgatgtatacaataggttctatcttcctcaccttaaaggtgtgagaaatgatggcacagagaagctggttaacttgcccaagggcacacagcgtgtaagtggcagagatagaactcaggcagtctggcttcagaggccatgttcttaacctttacactatactacttcgtgactctaccccaaaatgtggagtgaagttgaaattttgtgccccagaacatgagtttcagccactagggtcccgctcagggtcgggtctgatcacagggaagggtacggggagccaaacaggtaatatcacgggtagcagccaagttcccacccttgtgcctaaacccagctcaggtctttctgaagctaggagcaccggaactacggaggagaaacagctccgcgctctcaccagcgggccctcttcctcctccatatctgaggtcccagcccgcaacaccagttcccgggccgcagccgccatggtcgcagcggcggccattccccgcagcctcacttccggcaactgtcagtcccggcgagtccgttccccggagtggagctacaagtcccaaagggtcttcctcagcgcgaaatcgttcccagatatttgagttaagttgtttgactccagctgtcccctttcagctctaaccacttcacccaactgcaaatggaaatatggaagtctgaaacacaaactagccccggaaccttcgctgttctcttacctatgaaccttacgaactgtaaagaaaggcgcaccggaagttgtggtacccaagccatactctcataaatccagccaggtcgcgctgaaacagtttccggaagcacttctcctagatcgcaccgcctcttcctcctggaagctatataatgatatcgcgtcacttccgctctctcttccacaggaggyctacacgccgccgcttgtgctgcagccatggtaagrctggaatccgtgccgtgatccagcggcatcgcagctcgggcaaggaaagccggytgtcagggttctggaaacgtcctgycctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaaggtragtgaagtagggtaaggaatagggaatgtaaatgagaattgggttgtgaagacataagcaaaaatgaagcaaggytggggagacttgagtctcatccagatcaccttgactgctggattaagaaaagaaagtrgtttagggagagactgacccctttagcatttaccacagaaaataagtgattaaagccaakatagtggtctaaggtcaagccaaaacatttcacctggggaagtggggaggaggtatggttgctcacccgaattcgctaagattttcctgaaccacgagcttgtgagatttcttctagattcggtttctttacccatcccaccatcataacagcaacccttcctgcgaaatttatattccctgagaattggaggattattgggcatcttgagggataagtagaaataccaacagataaaaagtgtgaagaagcctgtagatggagggtggaagaagtctgagtgggacatttactcagatgagccataattgacactcctttcctgtcgaagtgtgaaggagtacatccatctttctttggcttttaagaatcgaatcaatgaatgcaagaatattatttcacttgagtatttctctccacaaacctaatgaattcttggctttstagatacataacgttctttttttttyccttaagtcagaatgtgtagttagttgtggaaatagcctaccagtatgtgtccatgcgtgcagggctaggcctgtcttcttggcttctgttgcatggtaggtacttaggcgacgttagggaatggatagtagtagggatactgttggctctgttgaggaatttgtagagggaaattccttctgttgggtgctctgtgaaactaataaggcagtgtgaaatactgtacttatttcagagaccggctgtgaggcttaagtagaggtgcagcattcataagtgtaatagagaataaccttcatggatgtatctaactaaaaattagaaatcttatttcatctatatctcttcccacacccattttgaagtaaatcttttcacttgtaaacatataattaaatttgaggcttagtgcagtggctcactcggaggctgaagtgggcggatcccctgaggtcaggagttcgagaccagcctggtcaacatggtgaaacctcgtcatttaattaataaaaaatttgaaagaccctgctctcttctgaatcaacctaataatttgacccttggtcatgtttatttatttatcccgagacagagtctcaccccgtcacccaggccggagtgcaatggtgcaatcttatctcactgcaacctcagcctcccaagtagctgagattacaggcacacgcccagctaatttttgtatttttagaagagatggggtttcaccatgttggtcaaactggtcttaaacttctgacctcaggtgatccacccacctcagcctcccaaagtgctgggattataggcgtgagccactgcacccagccacatttattttttgagactgtcgcccaggctggagtggcggaatcactcttcactgcagcctcgacctccagggctcaagtcaatcctcctacctcaactttccaagtagttggggctacaggtgtgcaccaccacatctggctaatctggatcttgctgtgttgtccaggctggtcttgaactcctgggctcagtgatcctccagcctcagcctcctaaagtgctgggattacaggcatataggcatgagccacggtgaagccaacccttgatctctttcttgcagataggaactgccatttgttttagtttcctggagcctactgtaacaagttcatataaactaagcagaaaattactcttggcgctggaggcacttaagaatcctaccttgcctcttcctgtcttctggtggttgtcagtaatccttagtgttccttggcttgtagctgcattactccaatctgttgctgtcatctcatggtcctcttcgtgtstctctcatgatttgtcattggatctagagcccaccctaatcaaatataacgtcattttacctaattatttccgtaacgaccttatttccaaatagggccacattctgatgttctagttggacaaaatgaggggcagggctcagtattcagttcctccttcactctccaaatcactttggttcatgagttcagatggcatgggtgctagtgctggtgttgatgtgatgctaccaatgtaagcattagtttctttttataataacttgggcagtcagttctgggcactgacaaaattgagtttgtgatcttggaatactttgattatggggatamagtgatttgcctaaataattgtgacccttagagattctgaggaactgacagcccaataccttaatcaaagcctgtaactcataagaccctggtttactgcatcagcttggagtggcaggccccttgttctcctaaatgcaagaatcagaaggcacttagtgacaactacatatgctgagcaatgggggaaaaaaaagatactgcctgctttcaaagggttgtctgtaatactaaattctgtgttcatgattcagtcatacccctgaacaaagttacttttttctttttttgagacggggtctcactgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggcttcctgtcctttctgtccattctaatagggartgttaaagtgctgggtcctttttccatttagagctgccctactcagttgcccacacagtgctattagttttagcagtggtgatgctgcagaccccccagtctccctatatgtagctagtgatgtccctctctgtaaagagaaatgtgagggtaaaacagttcagccttgaggggctgacccagaccagtttagagaccaacaccctggggttggtgtgcagcatcattgtggagtgggttagctgagcctagccagttgcagttaaggtgagtttgcaggtcttggtcactctgggtttttttgtttttgtttttgttttyttttaaggggtcatctagtcataagggaaaatccttcgggctgtgaccgaagcaacaaaggcaaaaacgcggacsttggttatgaagggtgtggtctccctggtggagtacgtcggtgggttgggatggggagcggctggacagaccggtctcactccgtttggtgccactccacccgcccgggtttccgcgccctgccgcgctgctccgacgccgcttccggcggggatgggagcgcgcaacgcggaagcgggcggcagaccggccgccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccstgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctctwctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccargggcctggcccgccagcccaaaagatggtcatcgggaagaraaaaagaaaaaaatgctgcagttgttctctcaagctagggcagaagaggggtgtcaagctcctcaataaacttgtctccacttcttcgagtgcagtgtggtcttcaccaggacccccagaacaccacaaacctggagagcccagaggctgccagaccctgctgcatgggaaggacatctccagggacatgggagagaggacagcctctctgaggaggaaggcccctaaaaggcaaagctaaggccacagcagccacaaggtatggggtgggggtagaggcaggacactgacccctccgatcctagaatggcctcatgcttggcaagggggaggggaacaggtccacaagatgatccagacacattatccaaaaaatcgctttcctctttaataccaacccaccccaggagacagctgtccacccccagttggggaaggggccacactgcccccacctccttgttccagggaacactcatttccctacaggtgatcttggggagagactgttcccaggcaaccctggagtctggctcagcgcacaaatctgtccagggcagatggccgggcccccgtgggcttggccttygcctccttatgatgctgctgctgaaggctctgccggaccttgtcctggggaccggagacggggaggacacaggcacagagtgagaagtggcaggctgacaagggcagaggcacaagcaggagggtgcagcctgtggaaggcccggcccatgccaatgctcatttaccctgtgttcctcatccatgaccttcctcttcctcttcaccaggcttgccgtggagctgcggcccttctgctttggctttggctggaagggagccttagcctgcgggtcatagccctgagggaggggacaggagtgatatctgttacagcctcggagtcagggaactggcagcacccacctgctggccgcacttctggggacaagccatggtggggagaggatgtgggggagaagacgggcctgggcattcaggggcctgctccataccagcctctctatctgctccttctttccctgctccagggagatgacatccacctcggccagggctcgtgggtccagacaaataagctctgcaggtacctgggggtgtcacagagggacaggactcagcaaggagccacaggagggtagcaccaaaaagagaagccagggaggctgctgaacccctctacccaagacccccagcatgagacatcaggagagctttctctacctccaaccccaaaccacaccttccccagcagcaggggcctcactctctgcagcaggggaacctcacctccaacaggggcaatctcaccctctccagcaggggggawcctgaccctctccaggagagggaatttcaccctctccagcagagggaaacctgaccctctccagcagggggaatctcaccctctccagcagagggaaacctgaccccgtccaggagaggggaatctcaccctctccaggaagaggaaaccttaccttctccagcaggggggaacctgaccttctccagcagtggggaacctgaccttctccagcaggggggaacctgaccttctccaggaaggaggaacctcaccctctccaggacgggggaacctgaccctctccagcaatggggggratctcaccctctccagcaggggagcctcaccttctctagcagggccttcacctcccactcctggcgctgcttccggcttctgtatggattactctccaggccatcgaagttgggctcaccggcccctgaagggagggagggagaagcatggagccataaggaagaacctcagtccaacagctccagcccaactaagcccccagttcctggatgtctctggcccaaacttccacccagagktcattcacttcaagccccatcccctggcccactcaccagggaccagcatgctggtgatgcccccagtgtgccccacccccagcacatcttcaaaggggcagaactgaaggccatgcacagggcctgagagccggtgggtgaggtagggctgttcaagggagggtgggctggccttgccctgccctgcccagatgttgacaacgtcacccattcccgccaccagcagtcccctctgggagaaggccaggtgccctgctccatggggcagggtccgagtgctcagaggctggtacgtccctcgcaagtcaaagatcttcagctggtggtctaggccagaggtggccatgtacctggtgagagaagagggatcaattaatatgtcagtaaatgggtttaccaagcaagctgtggccaagtccaggcatcaagtctggctggggagaaaaagattaatagtaataaccactgccatcaccctgaacactccacaggcatcctctcagttaagctgcacacaactcatactatttttatttccctttaagaggtgaggaaactgaagctcagggaaaggaaagctaggtcagtgaatggtcaggcctgtctctttagcatctgcctctaacctgctaacaccacacagccctctcaagacacgggcgtcaaaaggaacgcccacacgacaggctgcacccaaatgtgatgtccccctgtacacacatgcagcacacagcccagcaaggggaaggagcatgtgcagtggtcagaaaggcttcatgggaaaggtgggatttgagccattctagataattctcaaaaaattacaggaagtagatacacagcaggttcaaatgcattaacaccagagtgttgagactgagagggaagcagaggtttgttaggattggtgggaaacatggtcaggaaaatcaggagcagacaatttgtgaggtttctttaaagtcagactgaggacccacagctcatgatcccaacattgctctctggcagtgacaaatcacaaagtgaaggctccaaggacttgagaagacctactcagggaagtggtgaagtaatgcactggaggcccttgccctgcccctctgtgtgctttccctggaaggaaggagggaaggttggtgaccaaatcctctccaggaatcatgtactgcataagttgtttactttcagaagttggagttccttttctttttttgagacagggtctctctgttgcccaagctggagtgcagtggcatgaccctggctcactgcagcctctgcctccctggttcaagtgattctcgtgcctcagcctcccaagtagctgggattacaggcatgcgccaccaccgctaatttttagtagagccagggtttcgccatgttgaccacgctggtcttgaactcctggcctcaaatgacctgcccaccttggcctcccagagtgctgggattacaggtgaggttggagtttctatgttcaagttgttccttagagagggaagctgaagggggaccagccaggtaggggatgtatgtttgccaagaggccaaggagtctcttttttgccttggctgtgaacccaggagaagggaactgaagagttcttatgagcagagacttgcacagtgatggagcccaagagaggaccagctggatacttccgacaagataatcagcgccctgactttaccaaagagaaaggccatcagtgcaaaccaggaattaccgagcgctcgtggaacacagggtcacatcctttggtgaactaacaactcaaggatgcatgctggctcttctcccctccacacacccatctatgggacccctgggtaaagaccagcccagtgccaaatgggagtctactgtactactagtaagcagcagttcggctttgagaagtcaacgcaatccaatcataatacaagctaccagaacacctcttaagaaagatggtcagcctcatcactggagcccccgtggcctgacaagctcctgaggaggaccagagaaaagcagggatgggctgaagatcacaaggaccagagctgtttagcmtcaaggtgttgattaaacttcaggcctcagcgaactagtgattaagccctaagcacaggagtggctgacccaggtagcccacggagggcaagctacagctttggcccagtggcccagagagggcagaaacccttgggcaggccttctgactctcctagagccaggctggtataaatatggagtaaaaagggcagaaccaaatcactcattcacaaagatacaattacaaaggccagacacggtggctcacgcctataatcccagcactttgggaggacaggcgggtggatcacaaggtcaggagttcaagaccagcctggccaacatggtgaaattccatctgtactacaaatacaaaaattagccgggtgtggtggcacacacctgtagtcccagcttctcaggaggctgaggcaggagaatcgcttgaacccaggaggtggaggttgcagtgagccgagaccacaccattgcactccagcctgggtgacagagtgagactccgtctcaaaaaaaaaagatacaattatgcaaaaacagggagcgggtggtggggggggtggtcccagcatcctggagactttgaataagctggtggccaagctggatgtggtggctcacagtaattactctgtaatcccagtactttgggaggttgaggtaggaggaccgcttgagcccaggagttcaagacagagaccagcctgggctacatggtgaaaccccatctctacaaaaaatagaaaaattatccaggtgtggtggtgtgtacctgagtcaaattctgggtgacaggaaaattctgggagatgagagcaggtcaagagaaactttaggaggcggtgacctatccagtgatggacacattgagtctgggatgacagaggataactgtgtagaaactaatggcatcacctgagctaggcgtggtggctcatgcctgtaatcccagcactttgggaggccgaggtgggyggatcacctgaggtcaggagtttgagaccagccaagccaacatggcaaaaccccatctctactaaaaatacaaaaattagcgcatgcagtggcatgcacttgtactcccagctacttggaggctgaggcagaacaatcacttgagcctaggaggcggaggttgtaatgaaccgagatcgcgccactgcactccagcctgggtgatagatcaagactccgtctcgaaaaatagtaataaaataaataaatgcatcacctggccaatcattctcaaaaaccatagccatggccgggtgcagtggctcacgcctgtaatcccaacacytgcactttgggaggccgaagcaggtggatcacgatgtcaggagttcaagaycagcctggccaagatggtgaaaccccatctctactaaacattaaaaaattaactgggcgtggttcgtgggcgcctgtaatcccagctactcaggaggctgaggcaggagaatcgcttgaaccccggggggcagaggttgtggtgagctgagattgtgccactgcactccagcctgggtgacagatcaagactctgtctcaaaaaaaaaaaaaaaatagccacaagtttttatacctaaaggataacgggagcaccacaccagggcaggctcaacgattcatccttttgtctccagaacctcagcgcagagccctgcccacagcaggtgcccagtgaatacctgatgacaaaaggaatcagaggaaaatacaaatcagacagaaaagctgtggaaaatgcagatactccctcaggaacagcagaaatccaaagcagacaccacctccacccctcacatcagccagacctggagagaacgatcatcttgaatgacaatgatgaacacagcgctccctattttgctaagcgctgtgctaaactatatgccttaactcatcttaatgtctacaacagcttatatgagggctttaaaccaaggcttggtaaactactgcccatgggccaaacctggcccatcatctagttctgtatagcccacaagccaagaatggtttttacatttttaagtggttgaaaaaaaatcaaaagaatattttgagactgtgaaaaccgtatgaaattcaaattccaatatccaacaaataaagttttattggaacggggccacactatttacttaatactgtggctgcttttgctctacaacacacagccgagtggtcacgacagcgactacagcatcctgatttgcactgctgctttgtacactacaagtcacagtgacacagtcgtaagtgcttcacagcatttcaagcacctcacatatcacctatcattacctgtgtgaaaagatgttttcaaagatgaaatacttgcaatctctacagatcagcatgaacatgaatatctacagtcaaatttgaccatctggaacactaactttgtacatcaattaggcaaaatgttaacctcaaaaagagaaattcagttcttcccattagtagatctgtattacacaaathtatttgattattattattttttttttctgagaccgggtctcactctgttgcccatgctagagtgcagtggcatgatcacagctcactgcagccttaacctcctgggctgaggtgggaggatcacctcagcctcctgagtagctgggactacaggcatgcaccaccacacccggctaatttttctatcttctgtagagacagagttttgccatgtcatgggtgacatggcttgtttcgaacttctgggctcaagtgatctgcccacctcagcctaccaaactgttaagattacaggcatgagccactgtgtccagtctcatattatgttttgtttgtttgtttgtttttgagacggagttttgctcttgttgcccaggttggagtgcaatggcacagtcttggctcactgcaacccctgcctcccaggttcaagcaattctcctgcctcagcctcccaagttgccggaattacaggcccccgccacgacacccggctaattttgtgaatttttagtagagacagagtttcgccatgttggccaggctggtctcaaactcctgacctcaggcgatccacccgccttggcctccaaagtgctgggattacaggcgtgagccaccgcacctggccatattacgtttaattttataacctaaaaatgtgtgggccaggcgcagtggctcacgcctgtaatcccaacactttgggaggccgaggcgggcagatcatctgaggtcaggagttcaagaccagcctggccaacacagtaaaaccccgtctctacaaaaaaatacaaaattagctgggcatgatggcaggtgcctgtaatcccagctacttgggagactgaggcaggagaatcgcttgaatctgggaggcggaggttgcagtgagccgagatcacgccactgcactccaacctgggagacagagcaagactacgtctctctcaaaagatttaaaaaaaaaaaggtcaggcgcagtggctcacgcctataatcccagcactttgggaggctgaggcgggcagatcacttgaggtcaggaattcgagaccagcctgaacaacatgctgaaaccctgtctctactaaaaatacaaaaattagccaggtgttgtagcaggcgcctgtagtcccagatactcgagaggccaaggcaggagaatcacttgaacctgagaggtggaggttgcagtgagctgagattgcgccattgcactccagcctgggtgtcagagcgagactccatctcaaaaaaaaaagttgtgataatttgttttctcttggtatttaaatgcctacatggtaccctttgattttacctcttatcagcaaatcataaaatatttactatctgactctttacagaaaaagtttgtggacccttgaaatggacactcatatttccattttcggggtcaggaaactgtggcacacagaggttatgaaatatgcctatacttgcaaggcccatccgtggtaacactgcgatttaaacctgggcatcctggctttagactctgtgctcctaaagcacactgccttccacacctttctgcccacctatgactcctaacacctcaccccaccagtgacttacgtgcctgtagaatctactgccacagcccggaccccaccacgatgacagagaatctttgccagtggctccttcatagctggactccataaagacrcagtacctggaagagaagaagaaccaaagttgctaatacacacctaagcctgaggttactaaacatgggaaagatgggaactcaagaccaagagataacaaaaaagggaaataaaagggtaactttaagggactcatgaagtacaaatatagaagaaaagcaagtcaggatggtcagagtcaaaactaagccaggtactgaccattgctgtgtccgagatggatgacggcattgtaagggttctgactcataacatcgagccgcccagctcgagcattcagagctgccacaatcttccccactgacacatccaggtaggttagaaaccctgtttctgactgagagagaaagacagagagaatgacccagtcctgattgccctctgtattccctctgctggggtcctaaaggagaggtggtcatcccaagggcttccamccagttcctgagctccatggccactcacagctgtagccaggaggaagtggaagggcaggaactcaagccgtgttactcggtcacagcggcggatacagtggagctcaatgccctgattgtcatagatgtggagccagcggttctgagcaacagcaagcagtgcctcagaatggagaaacctgggggagaggaagagtggttcaattgggaaatgaggtcacaggctatcattcaatcaggaatggactatctcaccccaactgacygctgacagtgaggccactgaccggatgtcccgcaccgcctccatgacgttgatctcgcacataagcttctttgttacccaatcaagggcagccacatgacctcggcgccctccaaaagccaggtgtctgttggaggtgaggggcaggcagggtgttaaggcaggggaccaccgactcagacaacttgaggtctgccccacgccagccccatctctccaggcgggcagacacatgttgctgtaggtgcttaccctcacacccaagcaaatcgaaggaccctcccctcatcagcaacccaaacatacactgggaatggctgaagtggttaaggaaacacatcttagttcaagagtcactagaattcaaccttaccttccagttcgagagtagtttagtctgtagggtccaaactgccgcagattcaagtcaaagtgctgggaaagagaagagtgaaaaaaaagagtgccctgcagtaacgccttcttctagcccccattcctctattgtcctgcaccaccaatcaatcccttggctcctttacctcctcaggctcaccttggctgcacttgcaatgtccacagcctccacaatgtcagcctggcatatctttgctgtgtcttccccatcctccccttccagaaacctgaaagcaagggttaggatggcagtaaagcttcccaatatgaagcaagtataccaacataaaaacgagaaaagacagtcccawaaggcagggaatgggggtccagattagggctcactcacccaggttcttcagcaagcagcagctcagaacgagcagctttgatacttgtttcctcttcctcagcttcagccacctcaagtcggcttcgagttttggctttakaatgtggtagctgtaacattgttggtggggaggagtggcagaagaaccacaggataagtggggtcacaggagagctacctgtcccagcctccatccaactcacccagacactccctgcctccagcacttcccaactctccggctggacctcacctttcgrgatttgtcaatgcgacagaacttctggaccacttccacagggacgggggcggggcctgggaatggatcttgggyctaggggaaasgaggacgcaattagcagacagccttggattgaccccaaccctctcactctcaaggaacgaggcggcctgcctcgccacccatcaggtcccacgctcaccccggacaagccgcgctgggactccgggttcttccattctcggggtttcttcgggacctgaggcttcttagaratccgagacttctttaagatgtaagcattttttggtctctgaggacggagctcccgattcttcttgttacgaggaggccctggagaggctccggctgtggtcggaacggtctcttcctcccagtatcgccgcggtttctacaggcacatcaggaactccgcactcacgccccgccccccgaccccacagctaaaaacttcgtttcccacccagggaggcctctacctttctcttggtctgaagtttgtctttcttgggcgggacatccttgcccggcttgggggctgtctccatctcgcccacccgaacggcgatccacgtgcaaaactcytctcagctgccacacaktcggcttgaaaactcccggaagccctctgtccttcatccaatcagcagcgtaccaggtatgaagctctctaggtgccatcttgagtgagggcacgctctccttagaggggcggaacagtttttggcaccttatcgcgagcggcagcttatgcaagagtgayttaaaaaagaaaggcaggtccggrgccaggggctaagtagcggtgcggtttctttttctggattagtttccccatcttgcctaaaaatgtcctagtctagtctttktagcagaactccactccctaaacatgtcagaactacacttcccatcaagggtcagaaagaaacttccggcacagtcttttcccagcattccttgtttacttccgggtttattactactgaaggaagaacgtgagtaggttaggatttcggttgagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaagggtaagggaacagggtcggtatggtctcgcccaatgcacttacaacccaaagccattaccgagataaggtttgttgccccatctgggccctcgcgtgcagagacttccccgcctcagtctcagtactcttccctgttcactcacccgctgcccccatccttttctgcttcctcagatccatatccacctgactaggattgtggggataggtggcacatttgatgtttctaaatygcctttcctctcatccccagacttaagtaaatccatgtcggggaggcagaaacttgaagcacaactaacagaaaataatatcgtgaaagaggtgagggactgggatttgtggggcgaggagggacctgtactagccatggttctgatcacatatgtcccatccctccatcaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtragtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcmtgaccccatggtggggggaggggaggggaggggagggaatgaggcagctctaggatctatactgtagctaataaaatgtaaaaacacctggctctgtttcctgaccaggcacttctgtcatatccccacagccccttccaccttaacacacaccacctgtattaccccctcaggttcaaactcttgcacttggaatctctttgtggcacagtgttctttcttgaaagtgaaatcctaaatgtcttcaaacctacttcttgcctgtatatacaacccttaactctccctcatcttggttggcatgattcttttggaagggcatttgcaacataccatattgctaggaatgtcggtttaattgaaaaagaatacacagttctctaacctgaggccccaggatgaaatgtggttaccctccttgccaacagccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgccatttccttgtcctaaaattgttttatacacatttgcagcaagggaccagtggtagagaggttactggagagaaactgttctgaggaaacttttttcaccaatacctcactttttgctctgttcatggggacagaaaacattgtgccccttcctgttccatggcatctaccttcagccaattccccacccccactcatagcagccagttcatatgtactgcaaggacaggggagtagaattcaggtagtgttttggtttattatcttagtgttgtcacagtgatagaaacccccagagtgggaagaagagctcctgcgaggacctacattttgccattcccctctgccctggggctcagagccttgaagcctttgcttggcccttrcatgttaggatatggccaagaatcagaaactgatgcgtttttccagcactacctgtgtgctgcactcatggaaggtgggaagctatacacaggtatccaacttggttataagacaccagttcccacagggctggatttctcagctgtctggtaaaccagtggcacttcactgccccagggtggctggctccctttctgaatttctgtctcaatgtgatataattgccaccattcaggatggctacccacatctggtatgaacaccatgacttctgtaagccaacggggcttcctcctcagaacagtgcccgtgcaatcttcctccctgtggccttgatcctgggaaaggagccccctcctccctcactcggaggagttcctgaggcagacgggccactggtgacgccaggtgtagcagtagaggaccttcgccgctgccgcaggaggaaatcgtgtgaagctccatccatggcgtagaatacattagccgaggctgggatagtcagctctgaaggttcaggggatggatgtaaagcacacacacagttgttccccccacagccgcccagatgtggaagtactccactctcctcccgagtctgcctttccctcatggcctctgacctcgctccyctggtagcagctgtaccagctcatactctgaagccactgcagagtcacgattgtttttcttaaggacacgactgatgacacttggagccttgtcctggcttgtcacctggcagaacaggagaccaaaagagcaatcartcagccatgatttcccatccttctaccctcagccactgaacccaaccacaaaatgttacttgtgtccaaggctttaaaatgaacaggaaaacccaatatggtggcttcctataccccataagccagcccacatggtgcccagtgaaacagagctgcttccctgtggggaaactgctgttgattctgaaattttaacacggcgaccaaaagtttaaggtgtagcaactaatgcaaaatagccatcaaaataaaacaaatttcagcttctattgaagactagagtttagaagataaaattaaaaataaaacataactgccaaaaccaaaggtcaaaattaaaactacattcaattccatttggctgcccaaacctcagacaacatttatagtccaacaagacaccatccttcaccccaactccatcccaaggctccctcaccaaaatgctcttatagacactgccatcttcccccaactccatctggactcggatgatacggcaatcagaggcccctggcccagatccctctcccccatatccagtccccccggaggcctcttctgcacccccactcagcggggagccacaggaggctgagcggcggtgacctcgagaaggcctaggggaggaggctggtggggagaggtggctgrggtcagctggactgtgcagggatggactgctttccaaggcagagtctagtgacgagacagatggccacttcatgtgctaggaacaaacaacatgggactggcatgaaggcagggaggtttaaggaagaaacatttacagagtgagggtcagcgtcaaggtcagagtcaggagcagagctcacctgggccagccgagtcagcagaggagcaggagttgtaggcgcctcatctcccccagtactgggccggtcacaggacacaagcggggtagggaccccaacagagcccaaaaccctgcagtggcaggagattgggaggatcagagaaaagtggaagtcccaagaaaccaccccccagccagtgaatctctcactctgtccactgcgagatgaccaatgttggccgaagcacccgtggggcaggwgggtcactggaaccrggtggctccacctcacaggatacacgatggctgggttaggggggcaataggcagagctcaggacatgacaccaatcccccacacctggccagaaccctggagtcccaacctcacccgccagtcacctctgagcctctgtmagtggccggagcccctgtagccacctctggatatcatggtcaggttggaggttatagccacgrcattcattctggagccgtcgcaactcagaaaggactgcaaactcctgggaaggagccctcaaactgcaggagccaaaactcagggacccctgacttttccccctccccttcctggaacatggatagggaagtccagcatccagcccagacactccgctcaccttcctccgcttgtcaaaattgatgtatccattctgcgaggaaaatggggatggggtgaargttccaaccctaccttccggccacagagagagaatatcccctctcttaaacacacacagccacatccaactcacaaccacttccctccagcctctctgactcttcgatccctccctgccttcctcctcaatctatcatggcctaagcactccacttgaccctttaaattgaatttctcaggtagacaacgartctgctttgcagaygagaggactggatagtatccaattcgacaggattccttatccagagaggataaggaacttgtccaaggtctcagtatttgtttatttaacaaactctagcaatagagcaggagcccatcacaaaacctagatgtgcttacgtttcaggcacgttctaagcacttgacaaatacaaattcatttaacccttataacagatcaatgtagatgctatttctagtttcccatttacagatcactgaggcgacttggcacagaaacagatctggctctgtcccacactcagctatttgtgccttacagccccttgcaaggggcgggggggtctgtccgaccctgcagcccacttgttacatcattgcaatgacacacacacacaccactgacctccaactcatccttggaggctgcatccagcatcacaaggtccttcaggaaggtgccaaggtatgggaccacaccctgaagtcaggggtcagggtcagaagtgcctgccattgacgtgagggccctccatccctccgcacttgccctcctcattgcctcagagaacagatttcattctcctcacccctctgtgcctcccttacccatccttcaggctgctcccccaaaacatactcctcaccccttcataatcaccacccccacgcccaccaccccgctagtcactcaccccaccccgggagccagacctcggggccttcttggagtgtggctccagaggagactgcagcttcacctcctggtggtgacaaaataaaagagacatgggggagcagtagggaacaaggagaggtgggaatgccacaaaccaggctctcacctgcacgagcagctcccgactctgggaataattatcctcctcggagaaaatctggcagaggctggaaaagactctgaggctgtccctggggaagggagaaaagtggccctgaggacaggcctggctctgtcaccccctcttccccgccttctgaggaacccccaccccagtccaatgcctcagcctccgcacctggttgcttccccccaggctgcccgaagcctgtggatggggctggactgcagggctgacaccacggcataaactgaagagaagtttcggagcagccggcactcctgtgggggtcaaagaagagagctaaggctatgggaggcctctccattccatggccacaaaccgtagggcaatcttctctctcacctctgccacgcggatccacttctccaggagccgggccctctgtgggggacggagtggccgtatggtcacctccccaggtccctctccagtggaagtagcccccaggacagaactaaccactgcccctgccaccttgttaaactgtgtgacagtagctcggacagatgggcagaggtgagaatgtcctggccggtctctgtgaccccacaggcctcccaggcactgagaggggatcaaattgagaaaaagttcctgcagggtagaggtcagaggttaaagttcatagtcaagtgaggtcagccttccaatatcagggatctgaggatctcaggtggccaaggaaccagaggggcacagggtttgaagggtaacgaccaaagggaaaaggggagaatcaaaatggtaggtggaggaggctaggagctggatcaggaaggggtggaagcaaggaaaggatctggagtcaaggagaggttagtaaggggtcagggggcataggggccagaggtcagggtctcaccgcatctagcagggtcagctgttcggccaagtggtcagcgaggaacaccaggacatccgtggggtcagcagggggatcgccggggagggccaggggcttaggaaggtcgggggcctgggggtccacccgggaccggagattgcggatgaggtcagcgctgccccccccaacacccttccctgctgcataccctgtctgaagtaagaagctctcaagccggtcaagctgacccttggcctcagagccaaaatcctcagggtgagaggccagccaggttgacagtacagagatggctaccctgggagaagggaatcagccaagggtgagaggtaaagctgcagcctgggcagaggggactgtgagattaagaaccaggggtcactcactctgttgtcctctctagttcgtcggtaggatgagattcaagggcttccagcctgagggggagaagaggatctatctgtccatttttcccaaaccctcagtggctttgactattttggtgggatgttgcggctttaggaaatccgggcagatactccactaccctgcgtcccttatgactctgacctgtcagccataagccctagcaaggcaggcgtggaggtgaaggcccggtgggtagccaggaaggctgacatgaagctcacatcagtccctgatgtccgggtatccagtaggtgtctgaccagggcctccagagtgccagctcggagccgtcgggaggaacgtgggggaggcatagggacctggagaacacagagagatgatcgctaaccctttctcccactctgcacctagatttctgaggacaatcccagacccaggagatgttccagactcatttttctgatattcagagagggcaagagtcttggcctatgtcacacagcagagtccaggactccagaactccaacctagcactctggccagaaagtcagccagaggaaggaaaactgggaatgaagagtcagaggtgagaagctaaagtcatgatctcaccaagggatcaagaggtcgatattggcggcttgtgacrgtaaacacggcaccatcctcctcctcatcccagacggacacaggggcctggaggagcaaggaaggggaagtcagacagttccacaccaccccccattgccctcagccttcaccccaggccctgctcctccctctgtacccctcacctgtggtggcagggcatagtaccagcgagtgcgaggaagggttgggggagctggtgaccccaggtctcccccactggggcccagacagccccaccccagccgcctcagggccccggtggagtcgaaggggctgcagtggaggcgtggatggagtacaggaattctgatcctggagacccccaaagccccttctccccagagctgaacccacacacgacagagaagcagggtacaaagggcaggagagggaagcgagaggcagcaagccagaggcagcgactaggggtagctgaaacctcagtccaggcactgccgcatgccccgcccctcccggccaaggactataccagcccagagaattagtctttttcaggacccctttcaccctggtccctcgggtagcgcctccactatctcagccctaagggacccccgaaggtagcagctccaatcccagtacaggaaggaaaaggggaagtgggatgatagggggttgggggcggtagactcagagagtcacgtggccccagcccctcccccgaccgatcccgaaaaaccagccctgccagtcaacctgccctcacctaggatctggacctaggagtttagggcctcggggccccaaatccaaattctggcccctcctgaggcccgaaatcctgctcctggccaccaccattaatccctaatgaaaacagatgaccactctctacccaccctaggatctttcctccaggtcccagaaccgtggcttcccggcctctacccaggaccggggcggggcgggggggcggggggaagggggagagagggaaggaggggtcacgaaatctgagggttccctccccaatcccagagtcagaggagctggttactgtggaaacaaacccctccccgccaaacaaaaacaaggagggagacagggaccaagacacgactgctcagagaggtaggcacactcaggcaggcagaggtggagggccaaagacccgcagggacaggacagccagccagaagttccaggcaggaacagggcaggttcctgcgggcaggtcctgagtcacactgacagagaaccacggagacgccaggactccccgcagcagagaaacgggccgacacccagggaggcgcgagaataactgaggcaaggaggaggagatgtagggacccagagacaagagaaaagtggagacttcagaaatacatacgccccctacctcccaccacccgcgtctcacctcttcttcttcctcctcctcttcctcctgccccccgcccacgaccaggccacctgggcccccaccctcttcggggtcccggcttcggaagctgctcagtacgactcccccgggggggctcgtgtccaaaagcagccgcaggggccgcgggagcatggccgagtgaaggaatcagcggggtcgggccatgggggcgcctggggagagacggggtggggtgggggtggagagtcaggcaggcgcgggggaaccgggcagggaagggacgtgggtgggtgtcaagaagaccggaagggagttctgcaggaaggttgggggagggggcaacagaagggtggaataggggggcccttggtgctgttggggaaggaggaggtcacgagtacggggacgcgcagggtgctcaggctctgacctgctcgggaggggtgggggcagcgtgggtcctgagccgctgttgccgtcggtctccggccccggaccgagtcccctccccggcttttccgtacccccttgaacccccccgccgggctcctgggccctcccgccctttccgctcccccccgcgtccgcccgctccgagagcaggagccaaaaggggaaggaagtgaggacaggagccagggccgcggactaggggagcgctggacgctcagggaccaggacccaggcgcccgagtccccagctccactgtcctccgcctctacactcggggattctggagaccacgtcgacccgcaatgaactggaataaagattccagtctccagcccctgggggaaggcaggagcagaatttgacattcccttccccaacaataacacggctaaaactcccgcgggaagcgtttcaggcggagagagagccggtcactccatccccacgggattaccctccctaccacaacccacgaatgtagctgaccgaaatcccggccgggttttccgaagggccctcgattcccgccccctcggcagggggcggggcaggaagcagccacatccggttccagattcggctctcagaggcttccggcgccgagaccgagatccccgtcggctcggtgtatcctcgctggtggagtaccctctgcttgagcgcatctcatgcgccagtagtggcgcccgccccgaacggtgtcgacggggcgttctctgagcggttcagggtcactggaagggaccagaggtgattggaatattcattgagcttggaaaggggttggaatgagagaaccgtttggaagcactggaatacagctttattcctacacgattagacccgttaccccgtggstctggccgaccgtcctgactcggagatccctgagctgcgccgccgyttccttcgtcaacatccagcagctacttgatgagcgccctccagtgggccttaggtccctatgccggcgcggggttacagcagtggacagacaggccrgtccctgtcctcgaggagcccatgatccgcggggagacaggcrtttaacgacgactcacacgatcacttaaatacaactgtggtgaaccgcacaagagggacgcgcggcggtctgcggggaatgacgaggccgacctcgtctgcgacccagggagggcaagggtggaccaggcaaagggaacagaggactgggacctggaggtgggcgggaggcgtttggttcattggaggaaaggaatagccctgtgtgtgatgagcattgagaggaggtctggcgagcaccatctagggctgaagaactaggcagtggctccagcgyggggcggtgggggggacaagtgagccagggcaagaagaatggatttggccctagagtacgggttctccaaatgtaacctcggccctacagatctctgagactatgtcagggggtttgtgagattttataacaaaattaagatgttagtacaatatcgtgtttcgccgccgggcgcggtggctcacgcctgtaatcccagcactttgggaggccgaggcgggcagatcacaaggtcaggagatcgagaccatcctggctaacacggtgaaaccccgtctctactaaaaacacaaaaagttagccgggcgtggtggcgggcccctgtagtcccagctactcgggaagctgaggcaggagaatggcgtgaacccgggaggcggagcgtgccgtgagccgagatcgtgccactgcactccagcctgggcaacagagcgagactctgtctcagaaaaaaagaaaaaaagaaagattatttgcagccgggcgcggtggctcacgcgggtaatcccaatactttgggaggccgaggcgggcggatcaccaggttaggagatcgagaccatcctggctaacacggtgaaaccccgtctctactaaaaaatacaaaatattagccaggcatggtggaggacgcctgtagtccgagctacttgggaggctgaggcaggagaatggcgtgaacccgagaggcggagcttgcagtgagccgagatcgcgccactgcactccagcctgggcgacagagcgagactcagtctcaaaaaaaaaaaaaaaaagttttttgccttcttcattctataagtgtacagtggagtttttcagaagctacatgatatgtattgacaccatggttcccacgatgaatagaatgtgtgcctatgtattctcgtgttttaaatttttctcacttttaagttctagtaccataaatattgatagctataacccacatacccaaaagctttttggggtccttgatgatttttaagaggtcctgagagaaaaaaattttgagaaccactgtcctagagctccaagaaggtgaatgccataagatgtgtgttttttaaaaaagcatttctcgggcctggtgtggtggctcacgcctgtaatcccagcactttgggaggctgaggtgggcagatcacctgaggtcaggaattcaagaccagcctggccaacatggtgaaaccccgtctctactaaaaatacaaaaattcactgggtgtggtggcatgtgcctgtaatcccagctactccggaggctgaagccacagaattgcttgaacccaggaggcggaggttgcagtaagccaagatcatgccactgcactgcagcctgggcggaagaktgagactccgtctcaaaaaaaaaaaaaaaagaaaaattatcccttatataagtgaaagaaaaaaaaaaaagcattccagccactcagtggagagagattggagggattaggagcagatgatagggtattattttagggagctactacagaagcttgggccagagatgatggtggcttccacaggatggcagtgagtgccctcactctgctttctggaagagaggaaggtggtgaggaattcaggatattaaaaggcagttgaggtgtacatggtcagtttagagacatataaactatcatgggcacagatgatgggagaaggatgaggctaatattttctgccctccagacactgtgctgagtgctgtatctcctgcatcttcttaaggagatacactgtcttccttaatcctcctaaaagtcctctcaggctccgctgtccaatatgacagccaccacccacattaggctattgagcatttgatatgtggctagtccgaattgagatgtgctgactatttaaaataaacacctgtgtttgaatacttaaggtgagaaaagggctgcaatttattttcttttctttctttttttttttttttttttgagacagggtctcactttgtcacccaggctggagtacagtgggacaaccttagctcattgcagcctcaccctcccagattcaagcgatccttctgccacagctccccaagtagctgggactatagctgtgtgccaccatgcccagctaatttgttttgttttgttttgttttgttttttgagacagagcctcactctgttgcccaggctggagtgcagtggtgcgatctcggctcactgcaacctccacctcccaggttcaagcaattctcctgcctcagcctcctgagtagctgagattacaggtgtgcaccaccatgcccggctaatttttctgtatttttagtagagacggggtttcaccatgttggccaggctggtcttgaactcctgacctcaggtgatccgccctcctcagcctcccaaagtgctaggattacaggcgtgaaccaacgcacctggccaagactgtaatttctttttcttttttttttgttgttgagacgaagttttccttttgtcacccaggctggagtgcaatggtgtgatctcagctcactgcaacctctgcctcccaggttcaagcgattctcctgccccagtctcccgagtagctgggattacaggtgccgtcacatctggctaattttttgtatttttagtagagatggggtttcatcatgttggctaagctggtcttgaactcctgacctcaggtgatcctcccgcctcggcctcccaaagtgcagggattacaggcatgagccatcgcacccggcctgtaatttcttatattgtttacatgttgcaataatattttggatgtacaggttgagcatcgccgatccaaaactctaaaatctgaaatgttccaaaacctgaaatttttttagtgccaacatgatgccacaagtggaaaatcccacagctgccctcatgtgatgggtcacatatattattaaaaatattgtggtcgggtgcagcggttcacacctgtaatcccaacgctttgggaggccaaggcagcgggcggatcacctgaggtcgggagttcgagaccagcctgaccaacatggtgaaaccccgtctctactaaaaatacaaaaattagccaggcgtggtggtgggtgcctgtaatcccaactactcgggaggctaaggcaggagaatcgcttgaacctgggaggtggaggttgcagtgagccgagatcgcaccattgcaccccagcctgggcgacagagactctgtctcaaaaaaaaagagaaggaaaaaaatcttcaggccatgtgtataaggtgtataggaaacataaatgatttctgtgtttagatttgggtctgatcccaaagatattaaatatatgcaaatattccaaagtctgaaaaaatccaacatccaaaaacacttctgacccaagcatttcagataagggaccagaattattagattaaataaggtatattattaagttaattttacctgtttctgcttatttttttaatgtgagtactagagtatttaaatttacatatgtggcttgcattatctttctattggacagcactgcctaagtaactttttaaaatccctacacccaaggaaacatatagattaagtagcatgctcaaagagtcctacagttaggatatagtgccaggttttaacccagatcagtgtgaattccaagcctaggttctgcctaccacaccagcagcctccctccatgggttttgagataggatgaggagataaagtgacaagggaaagatacagagaggtggagcactgtaccttctttgaatccttgcaggtggacaggtagacagctgtggggaaagattgagaagggatgggatgctggagtggtagaggtggagggcagagggatgggtgtcaggctcttgggagtaggtggggaaagtccaccaacctcaggtcatggtcagggtagggctgacacttaccagcccagcccagtgccttgaagagcccaagcagaagaaaggcagacaggaaaaggcctacgctgtcctcaagggagggccctgaaagacctggcaggcagaaggggtgagagtgagctcctgtcttcctgggtgctggctcagattccgcagagctcccagctcttacctgctacctccagggtgacctcagcgctgcgccccgaggcaggcaggctgggatggtgaattcgacaggcatagcgtgccccatgctgctcagtggtgactgggggcggctgcaagtgcccagagaggctgacagagccatcggaatggtggcgcagggccgagagccacctctgcccctcggccttctgagagcggccccctgggccaccccggagttcccactccacctccaggcccccagaagggtagaagtgggacacaaggcagagcaattccgggggtgcctcccctggggcggcccgtgcaagggttgctggcatcagggacactttggggggttctggggaaagaggacgaaatgagcatagggaaatcagtccatactgtcctccctaagagaccctcagtttgcctgctggcttcctcagaactaaagaaggttaggtttcttctcctgaaatagggaacccactgtctctccattggtgcgtcacagaaatacccatgtcaaagcccctcaaatttccaggaaacttctagcctcccattacccctctaactcccaggaacctctttctatctctacttacttgcccaggcaccctcttatccatcatccctccccctattacggtccccacaatccagtgcccaccctctacccctggagacctctgtcccccaactcactgtacacagcaagctccagggtgacctgtccttgcaggtatggcaggtgtatggtggccagataggtgccctcctgaaagggttgaactgtaggcagccagaaggtcccatttccggtccatgggccccatggctcatcatcatcccaagcagcaaatgccacggccccttcttgggctgctggcatctggccattcagcccaggagttgcagccaggagcagatgtcccttacccaggtgctggcgtcgccactctagcccaaagggagggggacccggagccagagatgaggcggcctcggaggtggggggcatgtaggcaaagctcaagtccagcagagcatcttgtcccagtctcactcgaggggcaggggtgtgggtgaggacagtcagtaccactgaggaagacagggagatgaggggttgggaggggcatgagggagagaaagaaggagaaaaaaatagagaaatgcagttattggggagggctaaactgcagtttacccacccctcagaggacaccttttctgatactcaccatttcctagccctccctgcaaactccttttgctctgcgactgggtggcacctagtgtggctgagggtgagcagagaggtctaggggtggtgagtaggggcaatgagggggtatggcctttgaagcctactctgaacacatagcacactctagctcgggggactgcagaatccgaggccacttctgacacaacctgaaccactctatctccaagcaccacccttgaggaaccaggcctttcttgattacaggcgaagacaatgattgagccatgactgtcagtcttgtggtgctgtacagaatatttactgactctagaaggttccagctctagcctagacctgagcacagacctctatgctctactgaagcagtacagtgcagtggctaagtgcctggagcctggctgaccgggttcaaatcccctctgcagcttatttatatggccttgggccacttcctttttccatggctcagcttcctaatctctaaaattaaaagttgatgataataatagtacctacttcatgaggttgttgtgatggttaaatcattaatacctcttgctactcaagtctattcagttcccaattttagataacagagacacctacccatgaagggtgcttacaacactgtctggaacacagtaagtctacacgtgtttgctatagttacacctaacttagcataccccaagtcaacagcatctctgcaacattccccaccctgctccaatgcccatcttccctgtctttgatgaatgatcaccaagcccgccagacactaaaagcaaacccttggagttactcagactcatttattcattcagcaactattgagcactgaagatgttcaaggtatcctggtagaagacagaatggtgaacaagacaagcagtccctgctctcaaattgcctatagtccaatgacagacaagcaaattgtcaaaaataatgtgctatgtgctatccccaccaggacctaacagatctcacatctgtttccaatttaggttctcatcaatgtacgtttagacaattacaacagccctcctgtctggtctccctattctcagtctctccttcaactccttcttcacactgtagccaaacaaagtgactacaagtctgatcccatcacctacctgtttaaaaatcccaaatatgggccagacgcagtggttcatgcctataatcccagcactttgggaggacgaggcgggtggatcacctgagttcgggagtttgaaaccagcctgaccaacatggtgaaaccccgtctctactaaaaatacaaaattagcctggtgtggtggcacatgcctgtaatcccagctactcgggagaccgaggcagtagaattgcttgaacccgggaagcagaggttgcggtgagccgagattgtgccattgcactccagcctgggcaataagagggaaaccccgtttcaaaaaaaaaaaaaaaaatcccaaatacggccaggcgtggtggctcacacctgtaatcccaacactttggtagcctgaggcgggtggattacctgaggtcaggagttcaagaccagcctggccaacatggcaaaaccctgtctctactaaaaatacaaaaattagccaggtgtgggggcaggcacctgtagtcctagctacttgggaggctgaggcagaagaatcacttgaacctgggaggtagaggttgccgtaagccgaaatcatgccactacactccagcctgggcaacagagtgagactccgtctcaaaactaaataaataaataaaataaaaatcccaaatacctaggaagtcagctgataaaggcataggctgaagctatatggcctgggttcaatttctagccctgcttcttttttttttttttttttttttttttgagatagagttttgctcgtcacctaggctagagtatagtggtgtgatcttggctcactgcaacctctgcctcccaggttcaagtgagtctcctgcctcagcctcctgagtagctgggattacaggcgtccacaaccgtgcccagctaatttttgtatttttggtagagatggggtttcaccatgttgcccaggctggtcttgaactcccgacctcaggtgatccgcctgctttggtctcccaaagtgctgggattacaggcatgagccaccacgcctggcctctagctctgcttcttacacactgtgtgtccttgggcaaattatttaactggtttgtgtcctatatttatccatatgcaatacagggataatattaaaacctacaacctatggttgttgagaggaataagtgagattatgcatataaagtgcttagaacagggcctggcatatagaaaatacttgataaatgttagctgttactattttcattaccttcatcactatcatggacttgctggttaacttggaaaaatcatttaacctgtattttcctcactagtccaaagatctgacctttgcctatcttttaaaagaatcaagtaaaataacaggctttttccgggcatggtggctaacacatgtaatcccagcactttgggaggctgaggcgagtggattacctgaggtcaggagttcgagagcagcctggccaacatggtgaaaccccatctctactaaaaatacaaaaaaaaaaaaaaaaaaaattagcggggcgtggttgtgggtgcctgtgatcccatcaacttgggaggctgaggcaggagaattgcttgaacccaggaggcagaggttgcagtgagccaagatcaccccattgcactccagcatgggtgacaagagtgaaactccgtctcaaaaaataaatatgtacataataaaaacaggctttttagaataacacgccctccaaaagaacttctgatggttcgctctcacctacagaacaaagcccagctttcaaggtatttgaacattcagcccctaacccacccttccaggcttctcctgcaccctacaaaccagccacatagaacccctttcttgtgcctagtagaagtggtcatcattggtcat

SEQ ID NO: 10773 - DNA, 18936 bp, Homo sapiens
acctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattggcaaatgggatctaattaaactaaagagcttctgcacagcaaaagaaactaccatcagagtgaataggcaacctacaaaatgggagaaaattttcgcaacctactcatctgacaaagggctaatatccagaatctacaatgaactcaaacaaatttacaagaaaaaaacaaacaaccccatcaaaaaatgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactggttatatacccagaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagtcataaaaaatgatgagttcatgtcctttgtagggacatgaatgaaattggaaatcatcattctcagtaaactatcgcaagaacaaaaaaccaaacaccgcatattctcactcataggtgggaattgaacaatgagaacacgtggacacaggaaggggaacatcacactctggggactgttgtggggtgagggcaggggggagggatagcattgggaggtatacctaatgctagatgacgagttggtgggtgcagcgcaccagcatggcacgtgtatacatatgtaactaacctgcacattgtgcacatgtaccctaaaacttaaagtataataataataaataaataaataaataagaaaactgagaagacaaatagtgaacatttaggggagaatttaaatgatggatagaaatattagtgacattgataggtgggttgttggaaggaaagagaataagtgagcacctacatgaacttgaaggatgggcaacatttcagagaaactgttagccctaagcagggatttaaagggagagaaaggaaggagccttccaggagggacagaaaagagaaagtaaagtctcaaaagaaagaaattaatatttaaggaaaagaatatagactttggagccagcaggtttgaatttcagtcctggctctgcctcctgccggctgtttgagcctagtcaaatcccttaccatgccagaatcccaggggcctcagtgtaacatggctggacttggcctcacggctgttatagggttaaatgagagaatggactatgaaggtgacatttctataacatagtcatgtatttgagtatcaagattgattggattaatctggctggatattcttcctctatccctgcctcaagccacccctcctaaaactgcctcccccatcagggcaagttttactcagagtccttggagtagttgcataggaaaactgctctggtctaatagaatttccagctatgttaaagcacagtgtaaacatccaagtccttaaaaaaatgagtcattatagaaacaatcaagattgaagaaaatctttgggaagggcatagtgagtgggaattgagaaagaattatggtctccttcattttgatttcttacctcctagcccttcttttcccaatccagttttctccccagagatgcttcacattctttgttcaggccttttcacttctcttccagtcaacacaaccttcacttcttttacaggtcacctcctcctggaagacttcctgaaatgattcccacttgtccttcaatctgtcaacagaatcctccctcactcttcccccgtcactgcacctttaaaatttggtaatgacagatttaggttgatgatggatacactttatctgccttcttacacaccctaattcagtaatgctaaattttgttgatgatggatacactttacctgccttatcacacttcctaagggcagggaccatgactgtcctgtgatcagtctcccaaactcctctatcatacttatctctccctctggaaagcttctaaagactagtggggcttttaaaagcatgaggatgttgctaatatggaggagagagactgaaggataaatgaaaggatagaagaaaaaaatgaagagaaggaaaagaagggatgggtcaaggcctgtcccacctctgacattccctagtgccatgcatgggtatcaagctgtcacactccacaacaccacaagtaggaatcctggaaggagttggaaaggggtgggaacagttatttaggagacacctacattaaggaaggaagatgtggatcctagcagagagacaggatcccgtcatggtcaactggatcaagccaagccaagctgacacacgtaaaatcacatccacccttctggctctctggaaatagaatgaactcagtggtgattagagcatcaagtatagagttgttagggattctggaaagggagggagaaggtcttgagaagtgagatgtttccaggcagagtctgtctccaaatgccttttcccttactggtgtcctggaaccattaggtatgaactcattgtaacctggacgtaaaggttgagctgatgctttgttagcaggaatcctcaccatctggttatggaaggcaaatgacaactagtcatgaacttcctagccagactgagcaccatatgtcttataacacctgagcgtttcccagcactatgcctggcatctgccagtgaggcatgactattggttgagaaggataagaaggtctaagcagagtcaatcaaatgaccctctcaggttgtccaatcagtgtaatgagcaattcaacaactggacctaagtttattaaggctcactgtgtgccaggtgctattctaggtgcagggaaagcagcagcaaacatgaaggttaggtccctgttcactcaccttctattggacagagacacatcaaaagtccataaatagatcactgcagacagtaataaatagcatgaagataataaatatgggtaaagagatagtgaatacctttgagaaagaccacttgagatacaagtggtaaaagaagtcctctctgaatgttacctttgggttgagacatgagtgagaaaatggagaaagccatgtgaagctctggaggagcaggggcccaggcagagggaacagtgagtgcaaaggcggtgcagccgcaccagcagtggctcggggaacgagaagtagaaggcactgcagccagagcacaaggagcaaaatggagtgaccagcccacatgaacagccgtcattcaagaccatggttctcctgttagctaaacactgcaaccatctggaaagcttttaaaagtactgacacctgggacccacccccagggtgtccgtttaattggtctgaggtgtcacttgggcatcaggagttttaaagtttcccagataattctaatgtgcaactgaagctgttaaccgctgacaagcccatgagggccatagcaaggcacttggattggtgacaattgaggttcttgaggagtctcagagacatttctccagtacttcaagcccagatccaaaaagatcctgagaggccttggagttggggataagccaggacaatgaaggaaaagagataacatgagactgaaaagaaggtcaagagaggcagagacatccagaaaatatgacaaactggaaggtgcaacaacacagaagtgcaaacagactcagagagtcagagactggaggagaaaaggcaatcttgtgtattagtttcctattgatactgtaacaaattaccacaaacttaggagcttgaaacaatacacatttgttactttattattctgtagttcagagtctgaaatgggtcttactgggcaaaaattaaggtgtcagcagtgctaggttccttctgaatggtctgctagagaatccattccctcgtcttttgcagcttccagaggttacccacttccttagcttgtggcttcctgcctcagtctccaaagccagcaatgtcaggctgatcacttctcatgctgctatctctctatgctacctatcagagcatagaagtgcatcttttacaaaatagatttcagtcacaactgtagtcttatgcttgggtatctgtgtgttttatgagcactgagccgggagggttgttccaagatgaatgtacgtgtgtttgtttgtgtaggtttgtttatcagggtgtcatatttgagtgtctccccgataagtatgggggaggcagaagaagagtgcctggagggggtgcctaataaagtcctgctgctccataaagacttactgctgttatactgttattcttattaataataaaactgatgatagagtatctgtctctttgcctgttttctttgagcatgtccgtctgttcctaaataatactggacatttatcccagtgatattcaatgcatatgaggctattcatacacattatatttagctgtgatgtttgtattacatgaatgcttctgtctgcaagtttgtgcacatttgggcatttggacactgatggatgcagacacatgttatataacagtgtgggtgatcatagttgtagacatctggatgtttacttatgcacaaacccccatgagtatccagttagctaggcctggcattggaagggtagagaagctaggaagaggagggagcagggaggaagaggagaggtggggagaggagcaggtaaggagaaaaagagagaatggaggtgaggaatgaaggcacaaaggaacaccagaaaaaaatcaggaagcaggagggggtcccagggatctgcaactgaaaaaggcagggttgagtcacagcaagaacacaagtcagaagaccagggtagggctccacttctggtcattcccttgctatgtgaccttggctattccagttctctgggcctctgtgaactaccagagttgaaatagataataccgggtacattccaaagaaggaaggaaagagaaaactggtaataaaatcacacacggggaaaaacagagagaaagaaccagaaagagagacttacgaagaaagtaaggagaggccctgggagctggccagaggtagagctgaaagagctctgccccgactccctgaggccgaagtgtgggcgcctgctccccaccccttaccccagagctgcagaatgcccttaagcccttaataggtaaggaaggaagatggaaaggcgagaggcaccaggaatgaaaaccacacatcaacactcagaggcttgccaaagccacacaaaccaggatctgtgcttccggcccccagcccccagatgtaggtgtgccagccacctggaatgactcgcaccttggcaatgtgggcgcacatgccaagagtgagcctgggcacccggcccatgcgcgtaccacaggcggaggggaaggtaaaattggggctcttcggggggtcacagggggctaccctccccacacagggctaccccgccccagagcgccctctagtgaccgcctcctaggctctgggaaccaggtgtgctattctcccctccctgctcccccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaargttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggtgaggctgggcgcgcgtcgcggagttgttggtggaagcgggagrttcccggggaagccgggaatggcacgtctggagccggaggccctgtggaagtttaggcaaaggatggggtggggagagaaaagcaaaggatgagggggcgaggaccctgggtcctcaaggtgagaggcgcccggaaggacgatggatggagttgacacttggtccacaggggaggaggctggaccgatgcctgagccttgtgagaggggctggagagaagagactggggaggcagagaaggggtaccggatagaacgcggagagccctggagtcgccgcgaagggcatgggaactgcagaagttttggcagggcagccgcaggcgcccgggaggaggagagctggcggaggggagggagcggcgggcggaagggagagccgacccagctgagggtgaggaggggtcctgggaggatggtgggcgagggcagaacctgcttagaggagcgggagcaggaggctgggctggtgggttgggggcggagaaaaagctggggaggaggggactgacaagaggatggaggaagggagcaaggggttggggcatatccaaacctccccgtagcgtcgtgggggttggtctcggactctggctcaagctaagccctgtgttgtttgttattgttatttcggctcctcccaaggccccaggcaggagcggccaggggtggaggcgaggtgcgggagaacagccgctggggcctctggctcctctccacatcccagtcttaccacccatctacccccsgcgcctctcctgggccccggctccttggccactaaccagcccattcccttgcccgaccgacccctgggcgtctgggactcctgactggcttcttcccagcagccaagctggtcttgggtcttgcttctgccctttgaagtcttcatagacctaattagtctgaaagtaattggcacaattatgcaaattgtttctctctcccccgctccaccatatcggcctgctccagccatcagcactagacagtgaagtggaggggtcggtatcccagtgtttggaggggagcatccagtgccctctcctggctcccatagtactctgtggatctgctgggccttttgggacacattcaagtctagctgcctccctggccagggtccagagacacaaagcaaagggcccaataaatgccactgggcttttattgcaagaggggaagcagctttattgtaaggcttttatataccaactcttagcccgagggctctgggtgtgtgtttggtctgtgtgatggagggaggaagggacagatgtttttctgggatgcactggggaaggtagataaggatggggccgctgaaagagacagagaatgggactgaggaggcagcaaggaaggcaagggctctgaggacaagaaacagtcayggacgagcctgggaaaagagaattgagaacccttggggagtggaaagggrgaggacagtggggatggagttaggaggatgagggaaaagtgatggggtgagaggaaggagggmtcatgaaaggtgaaggaggagaatgagagggaaaggagcacagtgtgtaaagaggtgagatcactctgaaaggtgaggagggacactgctaactcagacagaactcacctgaggaggggagagatagggaaggatgccccagggaatgaagcccagagctcacatccatgtttgtttctgcccatcctaggatatgaggaagacatggagacggtgagttccacttttctgttccctccttttctcaccagctgccatagccatcacgttctcactgggcccacacctttgttcccattaataggcaggttttctggggtatagtctcatcccttcttcctccagagatgtgagtggggtatgcgtgggggcattaggatcagagggctgatttcctgacccttcccctyatctgtgtagatttgaagtcccaacayccaagtcatctaattcagaggatgatctccctgaagattatccagtggtcaaaaaaatgcttcatagactgacaggtaaggaaagaagaagggagggaagggaattgaatgaargtctgtgttagattttcttccttttagccctaaaaagtgatcaggtcctttttgatgtctgcattagtttcctagtactgctctaatgaagcaccgcaaagtaggtggctgaaacaacagacatttatctcaaagttcaggaggtagaagtctgaaatcaaggtgtcagcagtgttggttccttctgacggccatgagacagaatctgttccatgcctgtctcctagcctctggtagcctcacatgttctttgggtgataggtctgcacattttcttttgtatgcatttgtytctgtgtccaaatttcctctttttgtaagtcagcaatctggattagagcccaccctaatgaccttcattttaacttgattacctatgtaaagatcctgtttcaaaacaaggtaacattctgaggtttggargacttcaacctatctttgtgtgtgtgtgtggagtgggggagggcacagttcagcctataacaatgtctatcctcgattcctcatattccagccattttccctcttcctttttcatacattcaaacaacagatccctgaaggttaggtgcctctcaaaaatctctgcttccaccacctctcrtcactcctccctggaaggggaccccagcatctccttgacccttctttcctcactcactcccaagaagaagggtgcctctacccttctttaaactgcctagagaaggtggtccaccatcttggtcatccaccatcttgcccagtccagattgcttctgacacccctaatccagaaatttttcttcaaagcaccccatacatataaggycaatggttctttttctggtctctggctatcaccacctgctctcctcctctgccccacaacccctacagaaataggactgtccaccccaccccccaattcctgtgggtgggtgggctggtttctcaggataccttggattcctccctgtgcccctcccattacttgaggttccagtatcagtacgactttctctttagatgaaccttccccattttgctgacccagctcccatgccccaccccagatgatgcagattgaggtatcagtccttactcctccctcgaagtcagatcagcctcactcttcctcccccaacsccacaaacgagacaacctctcatttgatcttcctgctgtgctccctgcactgggccagtatgatccttccccaggtccaattctacagaagtggtgcatcagtamaaggtctgatattgcccaggyctgctcttcatatgccttccttctttttggtcctgcagtcgccttttgagctgttgtgtggtcactagctctcagtcttttacgtgatcttcgttgactattctccaccctaccccgcctgtgatttagaaaactctctsatgaggtcctctccctrcctccccgtctccagccgacctgaccctggaccctgggaccgcacaccgccgcctgctcatctccrccgaccgccgcagcgtacaactggccccaccagggacgcccgcgccccctgackgccccaagcgcttcgatcagctcccagctgtgctgggtgcgcagggcttcggggccggccgccactgctgggaggtggagactgcggacgccgcctcctgcagagactcttctggggaggatgmggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctrctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatcygggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctyagtggtggtatggatttgactgatctctgtaactgtgtatggcaaaaggaccggaaaatgaaaaccrgatcccagtaaggggtagagaggggccaagagaactgaacatctgggctgccggagaaatcaaagtctaggaagtaagaggtaagagtgtactacaggggacataccccaatctctttgctccctccctcttccttcctctcccagagacccaggtccctgggactatattggatctgtctctgaagctgaaaaacaaaaggcagaggagacagtcggctctaagtgaccaatctcaagccagctttgtcagaaatcctaaataacaggagaagggtgggaagaaaggatatgattatttcttrttccattttccataagaggtgagaatgacaaggacctcttttctaactcctcttgagggtgtgagaagggttagcaggaggagaagggctgggagctctgaggtctcctgtaagacctcatatctcacaggcaaggactaagaattaggattaaatattttagtgggatagctctaaaccaggattagcaagcaaagttagggcgcaaattcctggaatctgactgggaccctggcagtgaaagctgggactgttgaaaacccaatttaagtgttcgctactcatgttgagagtgcagggccaagataactagatcccaggacaggcagtttggcagtgagaacaaaaggaagacactgggaccaaggtgcctagatccctcgagagagaagggtgggtattgggaggaaaaatgaggactggggaaacccaggaggctgggttctggaatagcagcaagtcagaatttcaggatctctgttcgtcctcctcttcctcttccctctatcaggcagaagagagggaaggagggggctggagaagtagccacatggatacatttagggccagacagacacaggaatgctggaggagagagggatttagtgctgcattggccctggagggggctgggaagggtcaggaggctggggaggggtggtgggggtcggtcctagggttgcacgacgccgtcctttgcggtggccacgtacacagtgtgtatgaccacagccctcttcttcctcctcatcactttccgtggagctctcgccaaaggcccgaggtttctcataaatacagcagcctagatttagagggaggagcccagttaaagaggaggaagggtaagatatatagtcagttccattcccactcaaactcagtgaaaattcctattttctcctaccttccaggatccagcttccccaggcccaccctctgggactcaggccccacccctcttgtcctcttagagagccacgaattcaaagccccacttctcccacctctgacacttcttgctgtcagacctaggcaattccagttctagcccttccctacctctttccctgataccacagcaccaccaaaaaagtgacagaactatgaacatctgggggcttctggaaagccagtggatatgagtagatacaagatatgctgaagggagccagaactccagggctactgcgggccaacaattactcacatttggatgagcggcggcccatgtgttcattgtccacagtgtcacttgtccattctacctttttctctggcttccgtttccgaagtttgatggtaaggctccggttctcctagaaggttaaggatgagcatacctatctagtcccctcttactaacctttcccactccctcccagggaacctcctctcttttcttctttagctcaatcagtaccataggcatagcaccagaggagctgacagaagataaaacagaacaggtcttttacctcagatagtcccttgaggaataagtattatttcctgttcttataccaccagtataagagaagacacaattcctaacctaggaaaggtcccagcaactcttcaaaggaaaatataatccttgctgtttctccgtcttcctccccaaatcatccttggtagtattaatacatgaaaattatttttcagtccccagcacctaatctttgatctcccttcctttttccagatcccctattctttttctcttaaaaaaacaaacaaaacctctctcattctcaagctccagccctccctacctcttatccacctattctctggcatcctggcatctctagtagcaagtattactaatctattaattactaaacttcctttaatccaagagtattaagcccaatgcaaccttctccctttgaaggcaacttaacatgtttttggataaatacttcttgtttctccatttacatctttgctctctgatttctcaaaatacctcttttcatctccttttcttgtttcctcattcctgccacttccttttacattcatccattcaataaatatttattcgaatatcaatattgataatattgataagttggcctccaaccatgctttcttacactacctttgatttcctcccaacatcttcctggctccttaatcctcaatttccctttcgtttattacttacacacataaccaccccaagcagcaacacctatatcctaactgtacctccctattacaagttccttgacctgcctcctgcaccatctctgccactccaaatagctccaataccttccgattctcccagccctagatattcaaccccacacctcccatatccctaggcctagctcctccaacaactcttctaatccctgtcccctccctcccagtatctcccagacccctaaacagcaccgcccccccgcctttctcacgggctcggttgtcacggtaaccgttgtctcagtgacggtctcgctcagcccagcccctgcctcggccatggctaaggctcaggacagggaggagaggaggaagggggatgagacacccttccctttttctgtcgctgaggtctaagagaagcggtatcggattcagagtggtagccaggatcctccaccttctttattccccctcctcctgggcctccgcttctccacccctggggataacctggctaaccccacttccggctcgccgcttccgggtgtgacgcatactgcagtccccctttttcccttccacggcaccaaatgcgtcaaagcgcaggcgtcgctggattagttccgccgtaacgtgacagcgcgcaggcgctgaaagaaagagaaacaaatttggcggaaggggtgtcactgcgggtgtgggtggaggagggagagtctggggcagcacgcgtactcacagcctagaggaagcaggaggggcgcccagatgggtattgccgggccagacgctgcagagtgggtgtggcgagggcggagttgtgtgcaccaagctgagtcctgctgcagatttccgtttgccttgtctgggtaggtggaccggcgaggaagcttaaggagcaatagtaatgaccctaccgtggcctatttccctttccttgtttggtctgggtttctctaaagaaaacgggaagtgggagcagttggaaacacacttaagagtcaagcgatgtggttctacccctcgccctgtgcctgtaggtgtttgagcagttcagtttagtgcacgttcaacgtcagtttttttcagtcactgtgctacgccttgaagatggaggcgcgtaagacgctcagaccctgccttttagctctagtaggaaagacaggcatgctgaaaactaacaaaaatatgaaacactggggcattaacaaatgccatgtctgatttgtaaatctgaatgtagttacatactgccaacatattcgttctctctggggtgatgagtaggatgaagcagagaaatggtcgtaaattacagtataggctattttataaaaatatatgcacgtttcttagagagcaaaagaaagtggtaaaacaagaaccaggaaggccgacaagtaggtttttttagaagagcagcttaaaaagttgtagatgtgtgcactacaggaaatggagttttgtaccgcttggatctgagggagtgccagatgaagcttgacaggtaggcagtggttatatggaagaacctgtatgctttgctaagaaattaagcttaatccaatcactgttatgggccagagaaaggcttaaagtagggtagaaacatgaacaggtttgtttcagatttcaggagtgggtcaggaaagtcaactgccagaacagttcaaacgtacagtggggaagactgccctgcccattctccaggttgctgtgggggtcaaacaagatagctatgtttgagagctctgaatatatataaagggccacacaattatatgataattattacagtaaccccttgatcactatttgagccaaggaatgcgggacctgagtatgcatttgttccccttgaaagtttttagttcaaacagaaaaaagcaagatatagttcagcatgtctagtccattaaaaaaaccaaacacatatatagcaacacacatatacagagccacatacatatacacaagcacagatatacagtataatttggttatctctgtggagtaggattccttgtgactttacttttttctttctttctatataagaatctattataatagatatacaattcatccttgaacaacatgggggtaaggggtgctgaccctctgaacagccaaaaatccatatataacttttgactcccccaaaactttactgttgaccagatgccttaccaataacataaaccgttgattaacacatattttgtatatgtattatatacttataatacatataatcttacaatcaagtaagctagagaaaacattattaagaaaatcataaggaaaagaaaatatatttactattcattaagtagaagtggatcacattttcatgttgagtaggctcaggaggaggaaaaggagggcttaaatgtgctgctatcttatgggtctcagaagtagaagaaaatccacatatatgtagactcaagcagttcaaacctgtgttgttcaagggtcaactgtgtattgtatttatctcaatactaataaaatactcacctatagtgatcacttagtggcattacttagtatcagattttttgttgtccaaatttatatgctaaagagatctggttaaaatttctgttaaatgtctcactatccaaattcctagtttttcttaacctaaactcaggaaccaaatagatttaaatagtatggcaatacttacaattgctttttgtttatattagcctcattcctgactctacttttttgtcctaatttttcccccttttctttttcatataaatatatctctggaaactcatttaaattccttttggaataagacagattataagtaacatacatatgtcagggtcttatagaaaaatataactttaataaggaaattcaactaagggtaggagtactccaggaacaatggtaatccccacatgatgatctgattctcttctgggagcaaaacattgcaaccagacaggatggacaaggcatctaaaaacccagtatccttcaccttccgaaaggagggagggactgtagagttgcccaggaaaaaggtcaagagtcttccttctcctggaacctatgaggaaagaaaggacttgttatattcaccaaaagatgagtttctagtagtataagataagatatgcaatcaaataatcaaggaaggacttttatttatgacatcattgaggactggctcccctaaacaaacttccaattctaattccaagacaactaaaaattctgggattaaaaatatatccaatgagttataacctcaaagcaaagatttcttaggacacagaaagcactagctgtaaaagaaaaaaaaaaggataagctgaaccttataaaaacttaaaacttctgctcatttaaagagggttaagaaaataggcaagccacacgctgggaaaaaaaatcttctttttatttaaaaaaaatttttttttttttggtaaaatgacaaccagtgataggaaaaaaatacttttaaaagatatatctgactatgaatatttttaatcctttgatgagatggcaagaaagtaaaggcaatctgcacactggttaaaagttctgtaaaaccagaaatccagacagggaagttaaaactaatgtccctatgaaacgtgacagtgacactatggtgccctttatactgttttgacagtcactggaagcataggaaatgagggacaaaatgtataaggtctgataggagatcccgtgcataaatttgggaactgcaaaaggctgccctttcttgtaaaagtgaacaagaaaagaaaaaattcaactctatagaaggggaatttgactgtctcagtaggtagaaagagagaaaactctctcctgagaatttctaactgtaagctagcccttacatggatttgcagctcaaattcatactatctgtctgctccaaaaaacatgaagccaagaatttatttaaagtaattccagcttgatagtgcttcaaggcacctagaaaagaaacacaaatgctgagaatacagcactcgcccaaggcctcaaagaattcctacagttcaagttctaaaaaactcgaatttatagtcaaaaatcacaaaacaaagaaaaaaagcactatgagagagacagcagaaacaaaagacagcagcatcagacacacaaaatccgcagatatcagaattatgagacatagaatataataaccatatttaatattttaaatatatatttaaagaataataaaaggaacaatttaaaatatgattaaagaactgataattatttaaaaattaaggagatttgaaaagtaattaaatagaactcaaaataataacaatagtaaaaaataataatacttgaaataaactgaagacagaattagtgacatggaagagggacctgaagaaattactcagaaggtggcataaagagaacagcaattgaaaatatgaaaagaaggtgagagaaatggaggacagaagagagaaacctctttctagtaactaattcgaggtccagaatgtgaggactgagaacatgggggaaagagaatattaaaagagatgatggctgataattttccaaggttgatgaaaaaaaagtccactctcagtttcagaaagtccaacaaatcccaaacagaataaaagaaaatcgtattttgatatactatagtgactgcagaacaccaaagacaaaaatgaggtcttaaaagcattcagaaagcccatgttctctaagtcatgtgtgactaattctctccaaagaaagctaccttgactgcggttgaagactgcag

SEQ ID NO: 10774 - DNA, 22147 bp, Homo sapiens
ttctcaccataaactatgttggcaccttgatcttaaacttccaggctccaaaactgtgagaaaatgaatttctgttccaagcctcttagatatggaaaaaaagattctgttgtttaagccatccagtctctggtattttgttatggcagcctgagtaggctaagacaatgaaggatgtggtaaaactttacgtcccaaccacataccaaagaggctggaatttagcatgctttcttctttcaactgtaggcaatgtgcacaagttctaaatcctaagacatgttggctcctttactctgcccaaactacaactcaaacaaacaactgtaatataataacatccaatgaagttctgacatttcttcaacatgagtacagtaattcaatgccagagaattcattttattttgaaatctacatgccatattccaatttctgttgaagatgcaatggttatatttattctttttaatatagatttatcagactgggcgcggtggctcatacctgtaatcctagcatttgagaggctgaggtgggcatatcacctgaggtcaggagtttgagaccaggctggccaacatggtgaaaccctgtctctactataaatataaaaattagctgggtgtggtggtgcatgcctgtagtcccagttactagggaggctgaggtagaattgcttgaacctgggagcaggaggttgcaatgagtggaaatcgcaccagtacactccagcctggatgacagagcaaaataataaatacataaaatagatttatcagtttatcaataatatagttttcttttctaggtgtaaatataggtaatgactgtcctttagtacattttctcatgatgctcctcttacttggtttggtacaatattaagtattgaaataaaatagagaatcctgtcgctacacatgagcacttattccatttgctcatctccaatatgcacgggaaattctcaaattgctaataatcttgtaacacacatgcattatattcaacaggaatatataaatttataattataatttaggatcaacagatgacaaacctttagaaggtttgtatttaaccttaaaatataattttttaaaaattggttataaaatttctaatactttcttttttgtgacctcaaggggaaaatataattcttataaaagttcaaatgatttacagaatacaaaaagtgaatagagatgatgaatgaattaaaggaaaggatattgctacatagatttggaaatttaaaaagggaaattacgattgttgattttgtgttaaactgatctgctttgttcaagataccttatgtaccaaaaaatgattttatctcagcctcatatctcagtaaattcctgagacaaactttagtccctggtgcccaggtgcctttggtaattgggagacctctaggtttagcatcctcatccactcgccccaatttaaatagtcctccccagggccattcaggcaagggagatgaaaacttgctcaagagttggaatccaactgaagctaccgaaattcattgctcaatagataattttccctggaagtaactagggcttttgaatataatagtgggcatttcaaagtagaaggtaaagtattttggagatgaggagacaggacagagctacgaggaatgtcctttgcttagggactaggctcttagcagtacctcttaggtaagaactggttaactggcaccttctgtgtttctctgaagctccctttgcttagggactaggctcttagcagtacctcttaggtaagaactggttaactgacaccttctatgtgtctgaagctcccagaacaaactgccaatgaaatttggatttttggaatatagtttcttttttgttgttactttttgttttgttgtttttttttgagagtctcactctcactgcaacctccccctcctatattcaagtgattctcttgcctcagcctcccgagtagctgggactacaggcgtgcactagcatgcccagctaatttttgtattttttagtagagatggggttggtttttttttgagacggagtttcactttgtcgcccaggctggagtgcagtggcacgatcttggctcactacaacctccacctcccggggttcaagtgattcttctgcctcagtctcctgagtagctgggactacaggcgcctacaggtgaacaccgccacacctgactaatttgtgtagttttattagagatggggtttcgccatgttggccaggctggtctcaaactcctgacctcaggtgatctacccacctcagcctccccaagtgctgggattacagatgtgagacaccagatcagcctcagaagacattttctattggaaagagaaaacactattagcaacctattagtctaatatttaatacttaatgtcttccttagtaataaaccaactctctacaacaaagtgcttcctggctgcctagtcattgattcattcagttcaacattttctcaatgcccaacagccaagtgtctcctgtatgccaagttctatgctgattatcagtatttgaataagagggggtctacatcttaagtactgcttaagatgaaagcctctaggttaacaaacttaacacaatgtatcattcactactaaatagaccgaatacaaaatcttgttattggagcccagagagaagaattgaaattcaagttttctctctctccttttctcactcaccacaataagtcagttgcaccaagtcttgtagctctttactgagccatgttttcacgtgtccctttgttttatttgccacaccctaaataaaaattgtactggctttttttccctgggtttacagtattaatacattgtcaagatttacctcttcgtgtagattccctggggaaaattacctttcctccttcccttaaattcttcagaggttagaaagccattagtaacattctggtatgtggacaaagtttacccattatgtatggatgttttactctttctatttttctgacaataatctcttaaggaggtgtggttatagaatagtcagctgttataagtactgttttcctggccttacaacttaaattctttaagctgtttcttagtttgctcatctcaaaattcggaataaggataaaacctatctcttagattgttggattaaatgaattaacatactggaagctcatgaaatgtgcctggcacacagtagtgcctaataaaccatctctcttattcagcctgttttctgatttcagaatctacacttgctgagccaggttcttttcatttcaaggtgagcaaaagcatacaaggaagagatggaggtaggaagagattaagccctaggccaagggagctggaatcaaaggcaatttggtcagtgaataaaaaggattccaaggcccataaggcaattctaaccttaggatcgaaattctcggacatacaggaaatgctgggggggggaaaatccggtcttctcagcccaagagccatgtgaaaccagaccttcaaatctgatgattctcagcccagctgcccattagaatcgttgtaatttaaaaataccctcggaaaattctaatatgtggctatcaaaggtgatcatttgcttttatgccactttgttttcacccaaatgggacatccaacccttttcctttgagagtagttgtagggaaaggagggggtggagggagggaagagcggaaaaggctggatccgccctgagccggtgtcagtatctgggaagtgggaggcgcgtcagcagtaaacagcttctgctaggattattatctcctgccacacactcggatttgaaggctccaaacgaaacaatgcaaaacgcttcagtggagttccagaagcgttagactaaacgactgggtctgtttggccagtctgagcagctgggcgcagatgcataggcaagacttagcccgcctagacttttctgcccacttaattccgatcaaagcagaaaccggccgggcgcggtggctcacgcctgtaatcccagcactttggtaggcagaggctggcggatcacctgaggtcaggagttcgagaccagcccggctaacctggtgaaactccgtttctactggtggcgggcgcttgtaatcccatctactagggaggctgaggccggagagtcgtctgaacccgggaggcggagtttgtatgcagtgagccgagatcgcgccactgcattccagcttgggcaacaggagcaaaactccgtttcaaaaaagcaagcaaacaaacaaaaaaatgcagaaaccgagatccggaagaaaacctcggcgagattcacagaatccaggaaaataggtctctagaaatttgtccatggtcccagatctccatttcttgtgggtggggcagctgttaccagatccctagaagcaaaggtttttttgggggaccgtgtctcactgttgcccaggctggagggcagtggcacgatctcggcttactacaacctccgcctcccaggctcaagcgactctcctgcgtcagcttcaagagtagctgggagtacaaggtatgtgccaccacgcccaacttatttttttatttattatttttatttagtagagaggtgtttcaccatgttggccaggttagtgtcgaagtcgtgacctcaggtgatcagccccctcggcctcccaaagtggtaggattagaggggtgagcagaaagcaaaggtttttgagtggccacaggccccactctatttccttttctgcctgtaatggcaacctagacgcttgagcttcttaaaatacaagagtaagttgcatgtcaggcaccgttctacattagggacattagtctgttttacagacacctttcaactccctggttaacttttaggtaatatactctgcactttagcaggaatggaacctataactctcacagaattaggaaagtgaggctgcctacagcctaaattgagaaaaaaatagacgggggactagtcggaggaccaaacaaggttaccaacacgttagagttttgccttcaatttacatttttaaagtaatcacaacgaagtgtttagatcacgaggcatccctgcatgtaaactgttaggcactaactatggtcgatcttacaaagcattaactagaatatttctttagagtatgatagtacgtaactgacctactattacatacaaacagaccaacctttagtaacagcgctccccaaaaaccgaaaagcagtaatacgctttgctcaaggttggcataaaattaacttaccttagtgccttttttccttctacctacaagcagtgaggttagctcttcctttgaaacggtaggggggctctgaaaagagcctttgggtttgatagcgtttccgggagctcagatacctgtcaaatcacttgcccttggccttgtggtgactctcggtcttcttaggcagaagcacggcctggatgttaggaaggacgccgccctgagcaatggtcacccggcctagcagtttgttgagctcctcgtcgttgcggatggccagctgcaagtggcgcgggatgatgcgagtcttcttgttgtcgcgagccgcgttgccggccagctccaggatctcggcggtcaggtactctaacaccgccgccaggtacaccggcgcgcctgccccaacccgctctgcgtagttgcctttacggagcaggcggtgcactcggcccaccgggaactggagaccagcgcgagaagagcgggatttcgctttggcgcgagctttgcctccttgcttaccacgtccagacattgcaatcagacaaaaatcaccaaaaccagcggcctaagctcacgagaaaacaaacaaaatcaagaaatatgtaaaacatggccgcttttataggtagttcctggggagtaaatccgactttttgattggtcggtagcaaatgctagtcagatagccaatagaaaagctgtactttcatacctcatttgcatagctctgcccacggatgacaactgtgyagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacargtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatrtaggaactggagaggggtggggacaagtgttgcagcttagagagggacaaagggtcctgaacccgaaagaagccagccattaaaaatggstttggggtcaattcgttgtgcttaaatttaaaatggagacaagcggccattttgctaactcggcgttcccggaagaaaccgcaggctcgcttaggtttcagacccagctgtctgtccctgtctacgtcgccaggatcaacggttgccgtaatgtcataatttcgccaccagcttctagccaataggctgtcctgtcattttaaatattaaccaatcgagggaaagctgttttgagactctgatttacatagcggaccggagtgggaacctgggcagtaactgcctaaggaaggactccccctctgttttcgtggcgcacaccttcgtagtatactgaagggtgtgtctcctgggtttccaactgccccggtaatagtcttttaacctaatatgcgtcagttttgataacaacactaaggcagtacagaactaaagatgtaagcactgcgccagatgttgcttcatacatcttattctattcaactggtttattcaagattcaaatcaaatcaaattttgcttgaatcccagtgctcagtcagccataaatggtgtgttgcctgattgaaacttaaaatctcygtagggggcttgtaacatgcagamaagtttgaaagttgctttaggagaagccaactcttaactgctgggtaaattgacaagccttcgaacactgaactgaaggccagtaaggactaggcgctgggtgggggagaatgaagaggagacgtcattaaacttagcacatacactgtgtctcctagaggactctcccttcctagacaactgcaggccgctttgtggcctgggaaattccacattcccttaagtattttactcatggtcttttccaggtaaagattttaagatgaagggttagacgtagtctacctatctttttattcaagtctagaacacgtttttagcacctagaagtttgctttctccattaaaaaccgggaatatacaataaataaaattagtgttaaagcagatttttacaaacttaaataccatgtaatttaggttacagttayttaacataaggactgtgtgatcttaaatctgcaatttctttcacacctgggaaataaactaaggcctgtctttggtgccagacaaggccttatacttgaacactgctgtgcaatcacaggctgccttgcctagataacttatctgagaaattctgatgagaaatgaaatttccagagtccctcacaagtaaatttttttttctttttttttttttttgagacgaagtttctctcttgtttcccaggctggagtgcaatggcgcgatcttggctcacagcaacctccgcctcccgggttcaagccattctcctgcctcagcctccggagtagctgggattacaggcatgcgccacgacaccctggctaattttgtatttttagtagagacgaggtttctccatgtcggtcaggctggtctcgaactccggacatcaggtgatctgcccgccttggcctcccaaagtcctggattacaggcttgagccaccgcgccgggcctaaatggttttttttttttctatgcctctaatggacctggtcacttattcccattcagactgaccgctctcctacctgccaactaactaatcagtgtaaccaaaatctgcaaacaaaattcagtattctttccccgccttttcccctttctcttacatagattatgtttttgcctgtgttagatgaaataattctattgcttgttctctcttctgtacaagtacccagtaagcaaattattaacttcttggtcatttatttctgaattttccaccaagacagtgtttatgtgagtcatacaataagaaccaacagaaatgtgtgtcttggaaacaggttgtctatccctggaccctttgagttttctgttcactttcctttggcttttgcatgctaaaagtttatcgtccgcgtttgtttgttttggttattctaattggacttggctgattggttgcatattggtggcagtagtagaatttgaattctggttttctggtcacatcattaagtgattagtcagtggagaggacaggaaatctggtttatttattaacctttttttggggtgtttttgtttgaagatgttgatattctctgtgaggacacagggttagagttggtgtttttctttctgactttacatgggatttgatgttttgtgcttgtatgcctctttccaccttccaaaacttgtcttttttgagtccaaatagttgtcgatatctgcaaaaccagtattcctgtgttaagatgatatgaatataaaatggctgccctgttataacttttgactttaagaaagtgttaggactaacaggagacaaaaaggaaatcaaggaaaccraatgtctggtctcaataactgctatggcagaggctctacagcttattattaattttagtaatttcacattattgccccttcacgttctttaagtaaggttagaggacagaagaaacataatgttgttacaaattggactattgagtcaggraaaaaaaagagtgctttcaatatctgaataaaacaaagatttaatattttctaaaccttaacgagtttattgtaagggatgtgatgctggaaactaggaaactagaattttcttctaaactgagaatcagaattattcatattctcagcagtggtgccacctgagggacttctgatcttaattacatacttttatttctttaactgatcaacatgctaaatagataacctatggctctgtttttacccactttaaattctgttctattagcacggttagctttcctaattggcaataagattgagactatcttttttttttttttgagacagaattttgctctgtggcccaggctggggtgcagtggcacaatctcggctcactgcaacctctgcctccagggttctagcaattttcctgcctcagcctccccagtagctgggattacaggtgcaccaccacgcctggctaatttgtgcatttttagtagagatggggtttcgccatgttggccaaactggtctcgaactcaggtgatccacctcggcctcccaaagtgatgagattacaggcgtgagccaccgtgcccagaaaagactatcttattttatgaatttaaataattgtgaaattatccacttaagggaattaataaattataatgtaatcttaaattttagttggcttacataaagacttaaaatacatcaatttaaataaaaactcatttgtctaaaaaaaaatcaaaaattttccttgtgctttaaatgtgctacctctttaagttctaattaagagaaaaaaagtttaactgtgagtttcattagtggtcttagttaacagcttaaagtattttgtaaaaaaaatacttcacaatttttaaataacttaaaaatattaatacctcttttattagktttttttaataaggaaaatatataatacatctaatcaagattattttttggacaaattggcttaataatttcattttaaaaatggcttctttattcttatactgtaaaaataatattagcagaatattatagtatacacaagtttagggttcatattctaaaaaacaaaaacaaaagctaatttaacttgcatttactaaatttcttccactagttgtactggttacatgagttaacatcactttatttattattctaaaattgtaaattattcattgaaccaaattaaatgataatagataatgtcatttttaaaaatggaattaaattttatgttactaattataaggattcaatgtgtgagcttaagtactgagttcacagtgtatgataactttaagaatttaggtgaatattattaaattgagtaaattaattctcaatctttggatacctggacaatttctaaattggagggtacaaaatacaaatcacaagaaacagtgtagttttatgcaaataacatttttacacagtttagaataaccattgataaacagataagagaacatatgattgccttagaatagatactgttgctttcgccactttagatttgtaaatcaygtactgtatacgtgtgggcgtagaggaccatgcaggttttggatgactgcctctgttttcgtcatgcctatgcgggaacacaattgcctgctttgtttaagggctatggttaatccaaacagctctgactctatcaagtactatagctacagagaaacacaagtaagcattcgagataatgactaccttgagcctttacttatttaaaaagttrttactgtttgttaatgtggtacattcaatttactatggattgtcactctaaaataagacttcaatctttttcttatttttatatagccatgatttatattcatatcttaatgtaataaccaatcttctctgacaacattataacaatgctggaacctccattttcagtacttcaaacaacaaatactgcttttatacttcagagcagatggatatgtgcttcccagtgtaaacacatttggaatctcactgagaaatacactatcactaaaaatacagttctgagattcattaaaagacctccagaattctggaagtaggaagtttcctcttcaaagtctacagaggaagatgaggtctgaaatagacagcttcttccttcttttacctgtggtattattctgttttgtccttttctccattatctgtctttscagtgatgaaattttgatctggccctcccaagtattaaaaaacaagcaaataaacaaatctcagttatattttactaagatattggcatgctaactttttgcaggtttgtaacaaggacctttataacttgactaaaagttcctaaataagaatatttactagaaaatttatttctgcctgtggcccacatttgagtcaaaataatcaattaggaaaaatgaacttgtttaactaaagttgrccaaactgatctttgagacctattcatctaagacaagccaattaaattcttggagacaatttgtactttaaggaattcttataatatttgtaattaccctcataactttttttttgccctacttctgtgcttctctaatatgcagattattaaatgttgttacaaagccattgtcaaaaaaacaaaaaacaaaaaactaaacaaactcacatggttagacttgctcctttatgagatatttttaccaaaaatggaggagttgaaaaactctggtgccagaaatcgtgaagacatggcctacctaacwtggaaatgttggttgtcagtggaaaatactacacagagatagccatagtgctgcacagccaatcttaagtgtttctagagaatcactaattgtttctagagaatcactaattgttttcttttaacattcttggtttatacaagaagagagtatccatactaaactcttttctactgaaaataatgtgcaaacataacatcctattcctagacagtttgtagtttttttctcccatttctattttataaatcatctttttaaaatactttgttgagtgaaatcagtccattgcttgatataccttgagcacaagtaaatagtatgccaaaaattaaatgtctttcagtcacagtttgacaaactcaactaccctgagcctatagagtggtaataattgccctactcataaagatggggtgaagattaaatgaaatagcacctatagaacactagttccagacgtggtatcatgctagtaaaatggctgcacagcactgctcaatgatgacaaaaagtgaagcttctggagacagactccaagtttgactcccagatcaccacatataagatgtgggactctgaggcaggtcatttaatctctctgtgcattagtatccttctctatacctttacagtgatggtaatagcacctaccttctagaagtatgtgaagattaaagatccttaatgcatataaaccactgtgtttactgctgtttgacaaattttatttataaccatctttacgctcctaaaaggacttgaagcagcttatgactgaagactttggtaggagttggccttctataaattataagaatttcataaattatttgatatgraaatgccagttgatcatagtatgtttaccggggtccaacaggttgagaaaaaatacactttttttccctgaacatatgaaattagctctctaggcatattcctaaggacttaaagaatgataactatcatttctcttaaatcttccagatttggaaggatatatatattcagcacattgacagacaatcccagtagtcctaaattaaaagacattaaaaattagtgaaacttttcctacctttagcctgtgtaatcctggatgaccaagcataaaattaaattgagtagagtataccactgtaacatttcctgaaaggtattctaggctctgagtaatttctttggggtctgaagatcagtttgacatatcctcaagtatcatgagttcattataattaagaaaaagrgagtaaatctggagaatgagccactttcttactactccttgacctcagttctttttttcagagacagggtctcactttgttgcccaggctgccaggctggagtgtagtggcgcaatcgcatctcattgtaacctccaccttctgggctgaagccatcctcctgcctcagcatcctgagtatctggaaccacagcaggtgcacaccaccatgccaagctaattttttaaaaagttttttgtagagatggggtcttactatgttgcccaggctggtctcaaactcctgggcttaagtgatcctcctgcctcagcctcccaaattgttgggattactagtgtgagtcaytgtaccccgccccacttcagttctgaggaggaaaaaatatgtaataataatgggactttggtttgctgatttaaagattcatgtaaccttatcatccaatgcgcaatttgtagaataattaatagagacatctggtctcatgtttctacagttgctcatgccttgatagtagatctccttgctgctggctcagaagggtaaaagagcagaaatgatggggcttctctcattctatgaggaaatagacctatgtagaggaggctacctgtggtaaaaccttatcctcatcacttaaaattctaggcttattctctgaccatatcaagttttcaaatggtaaaagaattggattcaagagaaatatgaataaacttttgttttcacttttctccctcctctccccccattctcccttcctttattttcttgtccttagttttcttttcacttttttgtctactattatttgcccaaactcaactgtaggctagaacaaaaaaaaattgaaaattaaaatgtgccccttttgttgttagacttgcttaaacaattggggtaatgaaccttggacactagattttaaaacacacacatttgagcttcagtgcactgaaataaatatatttttaacaattaaaaaataaaattgcatgtttaaaaaatctgcagagaacaatacacgttgtgagatcttgaatggaaggaaaactgctagcctcaagagtggatcaaagatgctcagcaggcaacagagtaagagcatgttggagggtttagagagtgtgctcagggttctaggctctaaaaatcagacagtccccacggcctggccttcgtcgctgtatcttctttatgaaaaacactaagtctttttcctcactggataaatttttatccttcaagtttagatcaaatggaactttaggacactgactaggttacattcatcttttaagagcgtacagacattcaagggctagaggatgtgggtttactgcacaggctcattatccaacagctgtgctacctgggaaacttaacctctctgtgccttaatttcctcatctataacgcagggagaatgacagtaggtatctcataaggttgttggaacaactaaatgcattggtatctattgtgtaaagtgcttaaaacactgcctggcacagagcaaacatccagtgaactttagccatcatcattatcattgttctcagagtcaaatacaatatctcatatctgataaattacagaagtgaatcaatcactctctctcttttctccagggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgraaattcctgttttatagcactcatatttacaataaattttaaaaatcaytgttaacctaatagtccttcaaaagaaaaaaaaattgaaattacattattttaatgactctattagtgagggtcattcttcccatgtttcttgttagccatgaccctataagaaataaactgcactgcaaaatgataaacatgayatcaatcattacatgggaaggcactatataaagaataataccttaggttaaggccacataaatatttatcaggtgccttttctgcggaggactctgaagggatactaaactgcatttagctgcatgcaactgaaaytacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaaagaaaaaaaaaaaaagaggaagagagggagctctgcacatatactgaggaaaggctatgtgagctctcacagtgagaaggtagcactctacaagccagcaagagagccctcaccagaatccagccatgctataccctgctctgagacttccagcctccagaactgtgataaaattttgttgtttaaaccacacaatctatggtatttttttatggcagcccaagccaacaaagacagcatcattgctgtcacttacagacaagaaaactaagactaggagagagaaaagttaaacttgtccaaggtcacaaaagccagaaacaagtgaggtgagaagttgaccttgttctcctcaatccaaggccaggactcctccactccacatgtagatagccacctcacagtcaacagccaaatgtccacaccccagagtcagcattagaccaagatgtcttaccaggagacaaatgcctcatcttgaataaatatgatctaacaacttacccatgtaaaacattgaatctcatgagaaacaaaaatgcaaagtatgtagaaaactatgtttaccacttaactgacagtgataaaaagcttaatgatatccttatagtcttggaggggtttgtatatgtggtgaaacaggtgctcacgcactgctgatagactgtaaattggtcctagagagaaaaataaataaactggaaggagttatgctgtatgtttactttttttatggaaacatatgatatacctggaaattcgattggccatgcatctatttcttcaatgggtatgcacagttgagctgttcccatgcaccaggcactgtaatgggacaactgcacatgacagtcaaaaatctcagtctcatgaagtcgacatgctcatggagaggtgctacccactaaactaatatttgtatatcaattatggatacattgggccacatttacagaaattcacttacagtgggttaccagaagggattttttttcttgattggcaagaaggctaggctgttttgttgggggctggcaggagctgtctaggctgcccaagtatgcaggtctcttctatcatcctgtgttaaccatcttccatgtatctttcaacctcatggtcatctgcagcatgtctaggggtcatatctatgttccatgcaggaaaaaagggtaaagggaaagggaagtaggcatgtaccattttaatgcacaccttggttttcagaaaatttaagaagaaagactttctgcttttctctgactattctgtattctggattacaacgcaacagaaacgtcaccttaaattctaatgtttttctctccttgctttcaaaaactgactcattaacctccacgtggcttggaaaaattatttcagtcatccagtaatgagctgttcatagaaatgttttggacatcaagtctgtgttgttagcattatacatgttaagcattgaataaaaaacaacatgatgtgggtacatttctttacttacatataagtacttatatacttatagctgaaaagagaggttgaaatgtcaggtggaacagaaataagattacctagatgtttctcctatgggtgattttcagctatgctgatctttcttctgggtcaggtactcccagaacttcctaattaaatggtggccctgatcttagttcctctctcctcttagacattttccaggactacagaagatgtgcagtttataaatgagtagcagaaacctactgaacaaattattcaggctcatctgaacagagaggacaccttctctgctatactctctcagtgatttccctgccttggggtcaattattgtcttggacattgatttaagcacataataattgttgtcattgcttatgtttggatttcatctcccaaaatagatggtaaattctttagtttagagaccaagtaatacttacaaaaaaattttgtgtgtgtgtgtgtgttttttctgtgtctctcagccctgtaatagcatcgtacttacacttgttagatttttagagacaacttttacaaaacatggaattatctacataccctttctacaaaacagacaaattaaatactcagtagttgaaccaaaaaaagcagttcaaataaaatacttgaaaatgaagaaatcatttgaacagagttaaagttaatcgtaaaataatgtctgtaaaaattattgccaatcaaatataaagttcaaaaatagtgcttgaaaaaggaagaatcatatgaaaagggactactcattttaaaaatgttagatatcaggaaaagccaagaagtgagtatggtaagagtgctgtcaagtgaaaccctgctaatctcactgaacatgtaaaaatctgtagatgcctttattttattcactcacacacatatgtagaaagagaaatatatggtaaacattaaaaaaaacaaattagaatgtaaaattaatactttaaaaaatgggctgtatacttttcttatcaccggagataagaatttattatttttaaaataaagttattttctctgtgactgtttccatgactttgctacttagaagttagagatgccaaagtttatctaagaaaatgtttatggaaatattatttcaataatgaatgtttagaagactgaatttcctgactgggcacagtggctcatgcctgtaatcccagcactttgagaggctgaagaaggaggatcgcttgagtccgggagttcaagagcatcctgggcaacacagcgagaccctgcagcaaagtaaaaagaaaaaagaattgaaaaaggaagactgaatttcctttgggcaagtcatgtgacattcctgtgcctcagtttcttcatctataaagttaattcctacatttttggggaagggagagaaaaacttaggatagtgactggcacagaagaagcactatatactatatatatgtggatatcatttgtttttatggtaccattttagctatctaatgcaaaatatgaatcttttttttctgggtcttaaattatggaatgtaagaattttctaaattctctaattctgtgttagttttaaagcaatggagtaacgtatctgtcaacttgtaaatataaggatcaacctgatccacaatttgacccctagccactaatatttaatagtacaacactcagaaattatcaaaggtcagagaagccaaacaaatgtaaaaacatacaggtgctcagaaagatgcacctgtaatctctctaaggagaaatattttccaaactgagtgacacggtgctttagtgagttgtggaatcaatctcatgatttccaacctagtgttcttttaaaaatgaactagtccacagtagaatatactaaagtgctggtgcttaagatagtattgttttctggaaaaaaaaaaaaaattttttttttttgagacagggtctcgctcttgcccaggctgaagtgcagtggcacaatcatgctcactgcagccttgacctcctgggcccaagtgattctcccacctcagccttttgagtaactgggaccacaggtacgtgccaccacacccgggtaattttttaattgtagagacagggtcttgctatgtgcttaggctggccttgtgaactcctgggctctagtgatccactagcctcagcctcccaaatttatgggattataggcatgagccaccctacctggcctgttccctgaatttttttttctttcaggtgtttgtgcatatgtgtgtgtgtatgggtataacagagagacagagagaaagaaacttttctatcacactttgcaatcagaagtttgaagtcttatcttttggcttttgtttcagaaatatttcaaatgtagactctctcctttaccacactgtccccttaggcaaggtctttgccattcttctgagactattgcaacagactcccaacttctgactgtgggcccttctcaaaaatgattgtttatgcaataaatctaaacccaagacaactacaacaatacaacaaattctctgcttaaaaacttccaatgtctgccgggcgcggcggctcacgcatgtattcccagcactttggaggcagaggcgggcagatcacttgaggtggggagttcgagactagcctggccaacatgatgaaaccccatctctactaaaaatacaaaaaattagccaggcatggtggtgggcgcctataatcccagctaattgggaggctgaggcaggagaattgcctgaacctgggaggtggaggttgcactgagccaagatcacaccattgcactccagcctgggcaacaagagcaaaactctgtctcaaaccaaaccaaaacaaaacttctaatatctaccaaatgtttcacacaagtatttggggatcttcacaaatggcccttatggagttttcctttgctgagaccctatgctctggccacactaaactcattcagcatcccagaaaggcctcagcctttgtgagcaagctcttatctccaggcctctcacaaagacctgttccagtagaagctcaggggagcacactggacattattccaacaaccctttccccacagctatgcagccaaatctgccagctcagttaattaattaagcaattcagagatgagggtctgcccaggctggagtgcagtagctgcgacctcaagctcctgggctctaagtgatcctcttcagtctacccagaagctgggactgcaggcatgtgccaccacacccagctaatttttttttttttcagtagggaccaggccaacctagtcttgaactcctggcctccagccttccgaagtgctgtaattacaggcatgaatcactgcgcccagccaacccgcccagtcttgttagacatggggtctgtagtttctagtaggttcttgagtctagggttcctacctcatgttttatagttaatttaggggagggactgtgtctgtttatctggggatgtaggggtgggcagggggatagaggggacttcaattaatgaaaccagaagcaaaactcagttgaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataaggccccgaggccgcccgggtgtttcatgcttttcgctggttattacatcttgcgtttctctgttgttatgtctgaaaccgtgcctgcagcttctgccagtgctggtctagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattgg

SEQ ID NO: 10775 - DNA, 12745 bp, Homo sapiens
aaatttaccataatgtaacaatttctctgttgttggacacctagtttgtttcttctaatttttcacaaggacaaattatgctgtaatgaacatctttttgctaaactataccagagtatttttgttcactgaacctgtgtctgattttgtcattccttaacataacagctttaaaaaggagttacaaagttaaaagttaggagcatttctaaaatatagccacatttttgcgacatggttcctcattctgtttgcctcacagcacccctcccagcctcctaggcaggcaggccacactccaggaccattgctgccacctctctctcactgtcggtcagaatgactgcattttaaaaacagtaaacaacatgattattctaatgcaattaaacccaattctttcactcgttagtgattattttgtgagggaaaatctatatgagggaaaataagacctcagtttcctcatctggaaaatgaggggagtcacactacatgacctctcagactgttttgcgttctaacattttatgattcttatcttttgctgtggagacaccgagtgtttgggatcacaggacactaacagaataacaaaatgtaacctattcacttaaagctgttcagctgttatttaatcttgcttctctggaagcagatcatgaacaataactcggcaaattggaaatacttaaatacgaatgccatactgttttataaaaagaaagataacatttacttctggtatttaaatacataacccagtttttgattctcaattcaggctccataaaaccagatgccacagctggaaattctgattcaaacttgtaacttcacagaaaaccagatgctatattaaagataaggtttcctggagaagtatagcattttaaaaggcaactgaaaatctgtattagattttctcagaaaaacagaaagctccaggatactcctaagcattaagaacctgcacattaatggaaagatgaagctgccaatctgcagttaatatgtctaaacagcatagaacatactcatttgatgtacacacaaagacctctattaggtgtaatatacctaaaagtatctgccagatacctcgaaagcactataggcaaaagggaaacaaatgacagcacttttttttaatttggtgaaaattacattagtataaaatgtaccaaaaccaccctaacattgttttagtaaagaatttgagtggaaccttcttattacctgaaaaacagtaaaaattacctaaaacaatgtaattgggaaaacagagaaaaagaatttagggaaatgggcagtgttactaagttagcaagaagctaggagtcaataaaaactgtccttgtaaaagaatatttctgttcttgaaaattcatggcataaaagactactcaaggataaaacttttccttttatatcttttcaaatgaaactgaaaaggttcacaggtttggagtcaaattttacataaaaagtttttccctgtattcattatcagtgaaaaaaaaatattgagttcttactggatgccttgagttgaggaaactgtgttgaagaaaaaaaaatacacagctctttgccctgttgtagctctcagcagcagtccacacaacggagggatgggtatccctggaagtggaggctgaattgctaaggtgtgtgtgcagcacatgtaatttcaagggaactgatgtctaggtccctaaccttcatctgtcttcctatgcagatctgcatgagaatctgccatgacacacacttcatcggctctactttcccacatgcccgatgcaatctcctcctacttcagaaaacacagagttctcaccaaacccaaccccactatgctgcgctgtcccggatataaaaacctcaaacaaaacaacgctcagaaatcctggggaagctgagaacgtgaatgactctaatgactggacaacagagcctctcacaagtcaagggctcccaatttttttccatccaacaaaattaatagagaatctaactgagttgtcgtctggcaggtcactaaaaaaagttaatgacagtttcggcatgtaattcagaggaagttccaagaactgcgtggggtggcagtgccctaacaaaagctcccttcttatctccttgtttatgtaaatgagggttctcagctcttaacgtcactaagaaatgaaagttaagaatgaaattgatattaaaccttgtcagattctttaaaaaagtaatattcatctacttgcacacaacatcagtagaaaaaactaaacctatgcatcaccttgagaggctcttctgataaaatagtgtatttttattgttgttgtttaatccacacacactagtaataattacaaaggtaactcaacacagaactcaacatacaacacttagagactttcagtcttcactggaaatttttttaaaaattaaatttcaatttgcatatctatttctgtcgcacagaactatgataaaatgatcaataaaagatttctgggtcacaggagcaccaaaatctcagaaatcaccactaaagaacttatccacgtaaccaaaacaacctgttccccaaaaattactgaaataaaaattttaaaaatatttccaagcataaaccgggataggatattatgtggggaaagtgaaatggaaatgtgagttcaaggaggaaaaggttgtaaaattgatgactgtaaagttttttgagaatgtttttttcaacaaatgatggtggatatcaaatatggtattcagattccatgagatatatttaaaagagtgataaaaacttccactttaaaatgtcaagttttatagcacactgaaaactatatcctttgcaattatttaaacttacgataaagaattatagatgtcagattaatagatacatatgagcggttactcagtttttttcaaaattcttttaggggatacatgaataaaaatgtgtaaaggtcactgacttacacatctggtagggagaaaaacactaaacacgtatttacaaataaaattctatgaagcaaaaacataagcataccatgagagctgcctgaaacagaggaacagcgtttgtaaaggctgtgaggtggaggagaacataaaatgttcaaggaatcaagctggatcatgccatgctttctaatctagagtagagattacttatttttttttctaaagagatacctggaagggagtgttttaatcaggaaaatgatctattcagatttacttcttatgtatttattatctctcagaaaaaatctgttgcttatcagtaaaaacagggaattcattcattcattcatccatcaaatcttaactgaatatctgttttgtgccagactttattaggcactcaggatacaggagtacacagacaataaagctctgatacctctcgaaacttagcaagaagtatttactttcagagaaggaaaagtgaagttaaatgggagactaagagaaaatatttgcaaattatacacatgacaaaggacttgttgttcagaatgtataaagtactctcaaagtcaaaactaagaaaacaaaaaactaaattaaaaataggcaaaagacttgaacagacacttcactaaagaaggcaaggggggcacatgaaagatgtttggcttcattagctattagagaaatgctaattaacaatgatgtatcactacacacctattaaaatagctgaaataaaaaatactaaaaataccaagtgttggtgagaatgtgaaataactagaattctcatacattgttggtgggagcacaaaattgtacagccactttagaaaataagtagctgtttaaaaaaaaaatagtagccttattgagccctaattcacatagcaaacaattcatccatttaaattgtgcaattccatggtttttagtgtatttgaaagttgtgcaatcatatttccacaatctgttttagaacattttcatcacccccaaaatcccatacccattagtggtcactccccatttcccccaacacccccagtgctgggcaaccgatttactttctgactctatggatttgcctgttctggacatttcatatacagcagttccttcacttaccgtggggttatgtcccaataaatccataataaattgaaaatatgggaagtcaaaaatgcatttaatacacctaacctaccaaacatcatagcttagccttgcctaccttaagtgtgctcagtacacttacagatgtatttacctacagttgaacaaaatcatatccaaagaatgctggcaacacagtacactgcaaagtatgggttgtttaccctcataattgcatggctgactgagagctgatgtcgagcatcaagagggagtgtcataccgcacattgctagcctgggaaaagatcaaaatccaaaactcgaagtatggggatgggtgtggtggctcacgcctgcaatcccagcactctgggaggccgaggcaggcggatcacttgaggccaggtgttcgagaccagcctggccaacacggcgaaactccatctctgctaaaaataaaaaaaaaaaaaaaatcagccaggcatggtggtgcacatctgtaatcccagctactcaggaggctgaggcatgacaatcacttgaacctgggaggtggaggttgcagtgatctgacatcaagcactgcactccagcctgggtgacagagactctgtctcaaaaaacaaaaacaaaaacgaaaaatcgaagtatggtttctactgaatgcttatcacttttgcagcactgtgaaagttgaaaaatcatgtcctgaaccttagtaagtcggagaccatgtgtaaatggacttatgcaataagtggccctttgtgcctgttttttaatttaacttagcatattttcaaggtttatccatattgtagcaggtaccagtacttcattttttattgccaaataatattccattgtatggatatacattttatttatccattcatcagttgatgaatactcagattgttttcactacttgagtattatgaatgatgccgctatgaacatttgtgtacaggcagtttcttataccattaaacatacactcaccagataacttaggaatcccctaggtatttgccctagagaaatgaaaatgtatgctcatgcaaaaatctgtatacaaacatttgtagcagttctattcataattgtcaaaaactagatacaacacaaatgtccttcaacaggtgatagataattgtagtaacttcatgtaacggatactacttagtaataaagaaggaactattgatacacacacatctagaatcaaccttaaaggcattatgccgactaaaagaagtcagtttcaaagggtatatatgatctcatttatatgatgttattgaaaagacaaaattatagcaatggagaaccgtttgtgggttcacgggagtgggtgtgaccacaaacggacagcatgggagtttctgaagggagatggaactgttctgcatcctaatagggaaatggctatacaaaacacacatacacacacagggagagagtacaagaccccccgtggatgcctgaaaccaaggatagcattgaactctatagatactatgttttttctatacatacatacctatgataaagtttaatttacaaattaggtagagttagagaataaatgcaataataataaaatagaagaattctcacaagttatgtgaatgtggtctctttctctccaagtatcttattgtactgtactcacctttctttttgtgatgaagtgagaggataaaattcgaaccacagttgaccatgagtaactgaaactggaaaattaaactgtggataacatgggggatgggactattgtacataaaatgctaaaattcagagaactgtattagcaaaaaggtcaagcttactgtatgctaatctacaaataacacttaaatttttaaaaagcagctcttcctaagccagtgctcagcaaggagaaggccatgttcagttggagcgccaagatcgtgaagcccaatggcaagaagccaggtgagttccaaagaatgctagcaacacagtacaagacggcatgacactccctcttgatgctcagcagcagctctcagtcagccatgcaattatgagggtaaacaacccatactttacagtgtactataaagagtccggcatctcccaggctcttctggagctggaaawgaactcggacctcaaggctcagctcacagagctgaatattatggcagccaaggaaattgaagttggtggtrgtcagaaagctatcacaatctttgttcccgttcctccactgaaatctttccagaaaatccaagtccggctagtatgcgaactggagaaaaagttcagtggaaagcatattatctttatcgctcagaggagaattctgcctaagccaattcgaaaaagccgcacaaaaaataagcaaaagcgtcccaggagtgcactctgacagctgtgcacgacgcaagccttgaggacttgatcttcccaagcgaaattgtgggcaagagaattcacgtgaactggatggcagccggctcataaaggttcgtttggacaaagcccagcagaacaacgtggaacacagactgaaactttttctggtgtctctaagaagctcacgggcaaggatgttaattttgaattcccagagtttcaattgtaaacaaaaatgactaaataaaatatattcacagtaaaaaaaaaaaaaaaaaaaaaagttaaaaagcggcagctagctagaaaaatatacgagtttcctagtcccttatgttctagcctagaaaggaagcattccgtatttactgcctgcttaccactgatcggtcaccatgccacagaggcgacctcagaacaaatgaccttggctatcctaacacaaaagtaaaaggtattctgagtccaattataggatgtttttaacttcaacactagctggccttccatcactgctcaggagaattattaatcactattaaataaaatggatcatggctgacactccccctagtgcacaggacactgaagtgcccgtgtgaaaagcacctgcttttaggacttcaacttagggctcatatctgaaaccactgttactttgtttttgttttttgtctgttcatggtgtcttaagtatgtcatatgtggacctcaccacatatcccccgtttttgcttctctagaatacaacaacctatctctttgaactgtcccttcttgcctcccatttatggcatatatcctatatttcacttgagaggatcccaaaaatctggtgaaaatcttgtttttttttgtgtgttgcacaaagattatatataaaatatacatgagaagtttgttacttggagaccaggagtgccagattctaaaatgtcaggattattttgaagttaacaagaaggagctgctgtgtaacaacaaacaattttttttcttcaacttttattttaagttctggggtacatgcgcaggatgtgcaggtttgttacataggtaaacatgtgccgtggtggtttgctgcacagatcatcccatcacctaggtgttaagcccagcatccattaactactcttcctgatgctctccctctccctagtccccacttcgacagtccccagtgagtgttgctcccccaccatgtgtccatgtgttctcatcattcagctcccacttataagtgagaacaggcagtgttataaggttttctgttcttgtgtcagtttgctgaggataatggcttccaactccatccatgtccctgcaaaggacatgatcgtgttcctttttatggctgcatagtatttcatggtgtatatgtactgcattttctctagccagtctatcattgatgggcatttaggttgattccatgtctttgctattgtgaatagtgctgcagtgaatgtatgcatgcatgtatctttacaacagaatgatttatatttctttggatagatacccactaatgggattgctaggtcaaatggtatttctgcctctagttatttgaagaattgccactgtcttccacaatggttgaactaatttacactcccaccaacactgtaaaagcattcctttttgtctgcaacctcaccaacatctgttgttttttggctttttagtaatcgccattctaactggcatgagatggtatctcattgtggttttgatttgcatttctctaatgatcagtgatgctgagctttttttcatatgtttgctggctgcatgtatatcttcttttgagaagtgtctgttcatgtcctttgcccactttttaaagggttttttttttcttgtaaatttgtttaagttccttgtggactctggatattagacccttgccaggtggatagattacgaaaattttcacccattcttgtgacaaaaaggctgtcttgtaacaaaaatttaacttggagtcgaaagaccctaatttaaatgatcatgggttttggttacaatccagccatattttagacaaataataataagtataatcaatatattaaaatcaataataagtgtgttaacaaagtatggtaagtggtgaaagtgttacgggacaaaaagcaaaagtaatgcaaagtaagggaaatctaggaagagtgtagggaaaaaggtgaattctaattttcaacagggtggtcaggatgaacttactgaaaagatgacatataagaaaatgtttgaaggagaagtaaaagttatgcaggcaggtatctccaggcaaatacttagggaaaatcattccaaggagaggaaacaataagtacaaaggccctaagacaggtgtgtatcaagcatgcgtgaagaacagcaaggagactgactgtctattagatactcaggtaacagaaataatgtcaggtaggtagacaactatagatgtttctaagtgtagggtttcaaagaggtctgacctggaaatataaatctgggagtttctggactacagagaatatttagaactagggggctgcaggaaatcaccacgcatcgttttatgagcattttataatgggtgcctactatgtgtcaactgtgtgcaaaggagagagacacaaagagaaactcagcttcacaaaatactctgctagtttaattttagtttaaccaaagcaatggaggaaggcagaggaagagaaacacagatcatccccagtcatagttttttaaaaaaattagtcaaagaaagttaagaaaaaaagattgtgtgtaaaatataagtaatcttaaatctgggtcttaatctaggtgattaactgcaggtacctgctacatgtctcagatcctccttgtcaagttattcattaacattcttttcatcaatctgtccatcaagaaatccatgacatgcaattattaaaaagtcaggaaacagagatgctggagaggctgtggagaaataggaacgtttttacactgttggtgggagtgtaaattagttcaaccattgtggaatacagtgtggagattcctcaaggatctagaaccagaaataccatttgacccagcaatcccattactaggtgtatacccaaaggattataaatcattctactataaagacacatgcacatgtatgttttttgcagcactatttacaatggcaaagacatggaacgaacccaaaggcccatcaatgatagactggataaagcaaatgtggcacatatacaccgtggaatactatgcaaccataaaaaagaatgagatcacgtcctttgcagggacatggatgaagctggaagccatcattctcagcaaactaacacaggaacagaaaaccaaacaccacttgttctcactcataagtgggaattgaacaaggagaacacatggacacagggaggggaacaacacacactggagcctgttgtggggtggaagacaagggggagggagagcattaggacaaacgcctaatgcatgcagggcttaaaacctatatgacgggttgacaggtacagcaaaccaccatggcacatgtatacctatgtaacaaacctgcacattctgcacatgtatcctagaacttaaagtaaaatttaaaacatttaaaaaaagaaatccatgccatggcttgaatgtaggttggaagatgaatcaaaggtacaatgcattctgacagtttcaaagaggaatgcagcttgtccagcctacgctaatgtggactctcacagttccttgtgccagcaatgctttatcaaggacttcatatgacagctatgttttgttctatgaaactgaacacttgatttttatcataatcattcctaaaaatagtgatttcatctctaatacatgagttgaatattaatcgtaaaacaaatcttagggaggacagcataattttgatgcaatcctagtagcaatttctgaatagcctttgcttcaatagtttggaatatgtattgtttaggtacccaaggcagtctagaagtagctatttgaatctatgtggtaggggaatcaatagtccttctaaacctgggtgatggcgtatttgtatactagggcagctataaactgaaaaatcttaaatatgggactgaaaatacatacaatcaccaaacaacactcatgattagtgtgtgtgtgtgtgtgtgtgtgtgtgtgtgtgtgtgtgtgtgtgtgtgtgtatgcccctaggttaaggtcctcttaagcataaactaattctagctagctttccaaaacagaaggagaggagatttgaaaaatactaaggtaatgtatgaaggatgggttaaagttcaggttttatcaacctaagccctattgacattttgggctggataatactttgtctgggggcggaggtgggggtgtttgtgggagagctgtacattgtagaatgtttagcagcattcctggcctctttctgctagatgccagtagtagccccctagctgtaataaccaaaaatgtctccagatattggcaaatatcccctagaagcaaaattgcacgagccactggtttaaatgatcaaaagatgggaacggcaaggatacagctagcctctgcaacaactaaaccagatatttaaaactcctctagaactctcttaactcctacttgttttgtctgcattttagccttaattttctcattgcagctcagcaatgaaaactggccaccaacagctcccgagctttgtttgctgaaatccaggcctctggactaagaataattctttttcctaattccaattaaaaaaaaaaatcttaggaaaggattctgattggcctgatttgagtctggttgctacccctggtccatgacctagagagtagaagatactatggaaacacagcagcttgtactgaaaccacttgattgaagccagagtggggatgagttcccaggaagaaggcaggcactattgttgacagaagggtggtttcaggaccaagaataggtatgtgccacaatcatctactgctgattaacaagcacaccatagagcaaacagccaggacattaccagtcctgtataatactgaactagatttgcttttctgcatttgaggcacgtttgtgagttaggtactctgggaagcatgagttggtaagcaggtaagcagaatacacaatatctaagcttgaaggctttttcaccaacgtatcttacagtgacttcctggatgacacatttaagtaacccacagatgaaaactgggaatattgttactaaatattgctcaaagttagacatggcaaaaagctggcagttggtatgctttgtgggctattaataaaatatacttttaacatgcgactctgcctcagtcaacagaagaccataattgaccaaccattgctcagtttgtgggctgacagaaaaccaaatgtttgccttgaaactccaactgggttcaagaataaaatccaggaatataataataatatacatatcaaacggacataagggtattcaatttagaatttaaagaaggaagcagtctaagctgaaaaattttaagacttcccagagaatgagaggagacagacacaggaaatccttccctggttgtctctttaggaaacctcagaaattcggttctatgttaagtaaagaagtacctgtactttgagagtggagattctgatagagggggggaccctcgtctggcctggatctcaaatctcagctttgccttaggcaagccagagctcatggggtttcccattcatctgggatcttccagtagaagtagactcaagcgcctgattacagctttatcccagaagcagcaccactttatccagccaggagccaatcataaccaaaggatagagaaacaggtttgaagaaggaaaggaaagtgtgggggatttcaaccaacagagtcacagactgcttcgtggaagtcatctaatggtcatggccctcactgctctgttcttggatcttatggttgcttttagaggccacattccccggtgagcaacatactcaaatagacactactgttttcaaaagtagattatttaaatgtgacacactgaaaatctctaaaatcaggttagtaaaaatcacactgctacatcttaaacagatacccgacaaaacagcatggccaatgaaatctttaatgctgagtaaaaactaccccagcactcaatcttgacagcaaagccagaggtctgggatatctccttgctactgcagtaat

SEQ ID NO: 10776 - DNA, 12306 bp, Homo sapiens
gatgtgagattacatggccctgactgtcttgcctggtgctgcaggccaccttcacagccttgccataccttttcccatttatccatggattggtatgagccctaatggtgcacccttccgacaatccttcatccttcccagacgtttcatcagccaagtgaaatttgcaattgtttcagtgattgaaattatgcttggagtgcaggtgtcatggatgaaacagcaatgccttgcggtgacaaattcagtgtagaaataattttagcaagcccagtgattggaaaacaatgactcaactttaagctatattgattttgtatttctgggctcagcttttgactcagtctcattccccagaaataatccctgttaacatttcggtttgtgttatggaagtgttttctcttctatgaattagctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaaatgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtgggttgtttccacattttggctattgtgcataatgcttccaggtacacttgtctacacatttttgtgtggatataggttttccttttttggggtatgctcctaagagtgcaatttctggatcacggggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattctgcagaaaaaagtactgattgtccagcagttgtgtcaggtagaaaactgggatgcccgactgcattggtttagccagaactgtggccatgaaaccttgcctggcccccagggatggggtgaggggggatatcatatatgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcttggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgcatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctacgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgcgataatctgcctatttgaaggtcagccaattagcaatcttaatgccatctacaaccttaattaccatttgctatgtaacatatttatagatatcagggattagttcatgaacatcttggggtagagggcattccacatacagcagtacctataatgtatatgcttcttaaagaatgcatgagtcttatttattttatgtccttggagtgtatagcagagttagatagatctttctggattggcggttgattgaatattggctgtacaaagaaactggttaggagtatagagaaaagatcaatcatagcactagcttatagtttattttattctttaatgattttttaaaaatatttctctcacttacttgaaaagcagtcttagaaattaactggaatgggtaatttatttgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattgggattaagggaaaatcaagtaaatcgagaggtaaagcactgtgcagaaatattggccagaagctatgaacagttgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaactgaacatctgtctaattgttcacctccatcgctttagtgctttcctcatgctttctctctttccagacaataaactttattttcttcataagaattcagtctacgcaagggtattaggcagcttgtttgcaccttttaattgctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccctccacccctgccagaaataaagggattaatctctttttgcttggcatagggagaagacagtgtctgctgatgtgcttaactttttttttttttttttttttggtcaggtgcgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttaggaatatccagcaagccacttttaaaggctttttatcacattttattcttaagctttctgaattccttattatattttgcctgataaatagttggattttgttttttggttcaatgtaagaatattcttaaactaggtaaactgttttaattgtttgtcattatgttctctcattctgttaaattttgttttctatttttcatgtttttgggtttttctagatggcctgtctttaacacttcttgatatttttgattaaattttcatatatcatcaaaaatagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtctgtatataaaaaaaagtatgtatacatatacgtatatgtatgtgtatagataaaaatgcatgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgcttgaacccgggaggtggagcagtgagccaaggtcatgccactgcactccagcttgggcaacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaataactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggatagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaagcaggagaatttctggaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgacagtactccttatgaagggagtcatatgagttgctagctgggttctctggatggtggtgtcatgccaacatgggagccactagcacaaagaacatgctaggttctgttgagacctgactttgggaatagcataggtacttatctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccggtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgttattgtaaaagcatcatgcaccaggtaaaatgtttaataacacagagaaatctaattgtcaagtatcttctcaacacacattaatcaacaattctcatatcgaaggataacctcttgtatttacaaaaaaaagaagaaaaagtgctgtcatcagtaaattcattcatgtatgttatacacttacatacaaaatgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattatctgggtgtggtggcacatgcctgtaatcccagctactcaggaagctgaggactgagaatcgcttgaacctgggaagtggagtatgcagtgagccgagatagttctactgcactccagcctgagcaacagagcaagactccgtgtcaaaaaataaataatatatgtgtgtgtgtgtgtatgtacatgaattatatacaaatgagggaaaatatacaaatgagttgaatatatacaaatgagggaaaaattgttccttgtgtcaggaacaattactgtgaattttgtgtagcttttcctgactttttaaaattcaaatatatttcataaagttgaaatcacactgtggtctttttttttttttttttttttttaaccaaacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctggggctaaataagaagtttaaatgcaaatagataattcttgagaaagcttcttccctgtatatactctttctgcagcagtgtctgagtgtctgtaccttcctataccttcaccatatcatgtatttgtcattttatagtgagttgtattacttgctaggtgagctggtatctcctttgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgctttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactgttcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcaccagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaaaaaaaaaaaagttgcagaaatagcaatatttaactatacttgttactcaaatttcaccactaaagcagtgtcatctttttattccaggatctagtccaggatgccacattatatttaattgttgtatctccttggtgcctttagtacttttttttttgagacacggtctcactctgtcacccaggctggagcacagtggtacaatcatgggttactgcaacctccacctcctaggctcaagcgatcctcccacctcagtctcctgagtacctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacagacatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtatctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcttgtcgcccaggctggagtgtaatggtgcgatatcggctccctgcaacctctgcctcccgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaaagtgctgggattacaggtgtgagctacagcgcctggcccctccc

SEQ ID NO: 10777 - DNA, 16216 bp, Homo sapiens
ttatggttatgaagagtagagttcctttacaaatatatttctctgcacctgaaaatgtggcccaaaaagccatttgcagaattgatgatggctgtaatagagctatctggaactatataaaggctaagattagtttgggagttcacaggtagagggcatgggtttttgcactctgagctaagattccttggttatttcaatatatttctcatctattaacttcatgctagctccttgactagagctccttaggctagagcctaagtctggttcattttacattatggctagcacaaatctggtgttcacaaattcatagtaatatacaaatcagcatataacatagcattctgtattatttgtgactatttatatatgggattagtgttgaaaaatgaggtagatttcagcctgcatatgggatttttcctctgcagatagtgacttcctcttgaaataaaaataaaaagaacctaaatgatgagtatgtcatgatacatgatgaaatgtatcataaaacaacaaaaaggtttttcttgtcaatgtggctccaattgttttagtttgttaaatgttcctctctaagtcagatgcaataattggaaatggttgactatgccctctccagtgacacatgccctcccttcctctgcctgaatcctgtgggaaaataagccaattagagatcgatttcatatcctcttatctagcagcttagttttgagtgggagagaaatggaacagtgagaagctgatggacaggacaggggcttgggagagaaggcaggagggttggtgttacattggtacatttagaataatacatggatttagccctagtccttaggttttctttgagatggaaatccccaggttgagctgtggtctagaacacctgctagaagccacaattatattcatagaatgaaagtctagcccatgagaatcttctatattgggtgatggtctgtctgattaggaccatttgtatctttttctctttctttaaacattctttgctttataaatggccttaaaaatgcttcacttaaaacttattttctgtatccagtctatagctgatgggcatttgggttgattccatgtccttgctattgtgaatagagctgcaatgaacaaacaagtgcatgtatcctcataatagaatgatttatattcctttgagtatatacccagtaatgggattgctaggtcaaatggaagttcttcttctagatctttgaggaatcaccacactgccttctgcaatgtttggactaatttacactcccaccaacagcgtaaaagcgttcctttttctccacaacctcgccaatatctgttgtttcttgattttttcataattgtcattctgactggagtgagatgattggtatctcattgtggttttgatttgcatttctttaatgatcagtgatgttgatcctgttttcatgtttgtttgttggctgcatgaatgtcttattttgagaagtgtctgttcatgtcctttgtccactttttagtggggttgtttgttttcttctagtaagtatgtttaagttccctgtagactctggatattagacctttgtcagatggatagattgcaaaatttttcaccccctctgtaggttttctattcactccgatgatagtttctttgatagactggataaagaaaatgttagtacataacaccctggaatattatgcagtcataagatggaaggaaggagatcatgtcctttgcagggacatggatggagcaggaagccattatcctcagcaaactgatgcaggaacagaaaatcaaatgccacatgttctcacttataagtgggagctaaatgatgagaacacatggacacatagaggggaacaacacacactggggtctggcagagcagggagggatagcatcaggaagaattactaatggatgctggggtttaatacctaggtgatgggttgatctgtgcagcaaatcaccatggcacatgcttacctgtgtaacaaatctgcacatcctgcacatgtaccccaggaaatgaaagttgatgaaaaaaaaaaagacttgttgagggcttaccctgccatgtgtcaggcacttttaaataaatatatggatttagctattctcacaactacctgtgaggaaataccattattttctccactttagagatgagataattaacgcatgtgccttgatcaaggacacatctcttctaaggtacacagccgaggtttgaacttaggtaaacttgctcccaagcacacagtcctaaccaccaaactttactaacatgggctgccctaaatcactgaaaatagtccatagaagctattccacaatcatacatatttgtatagtatataggtgtatatgcatatatagtttgcaaaaggtctatattgtgtatgttttgcatatagatatacaatttatagatataatttacatataaatttgcacatatagacatacactttcatatagatgtctgtatggtaatttgcctatagaagagggtctagaggaattaaataacagtggttatttctggtattggttttttaaaatattaatctctttgcttgtgtcttttttgatttctctgtgataaatatatgatggttcatagctaatttttcttactttaaaaaaggatttgtatttctttatttaggaaatttaaaaatatgcattgactgagttcctgcttgctcagtacaaaattatacaaagcctgagaaaaccttgggttggacatagaccaatggaatagaacagtgaactcagagataagtttacatatttacagccagttgatttttcagcaaagttaccaagaacatacactagggaaaggacaccctcttccataaatagtgctgggaaacctggataaccatttacagaagactgaaactagacccctatcttttaccatatatgaaaatcaactcaaactggattaaagacttaaacataaaactcaaagctataaaactactgaaagaaaacagggaaaatatttcaggacattggtctgaacaaagattttatggctaagacttcaaaaggacaagcaactaaatcaaaaataggcaaatggcactatgttaaactaaaaagcttccgcgcagcaaaggaaacaaaagagtaaaaagacaacgtgtagaaggggagaaaatatttgcaaactattcactgataggggactaatatccaaagcatacaaggaactcaactcaacaacaaataatcctattaaaaatgggcaaaggatctgaatagacattcctcaaaaggagacagacaaatggctaacagctatatgaaaaaatgcccaacatcactagtcattagggaaatgaaaatcaaaaccacaatgagatatcattttaccccagttaaaaggactgttagacaaaaaataacaagtgctggtgaggatgtggaaaaaagggaactcttatacactgttggtgggaatgtaaattagtacaaccattatgtaaaacagtacgaagttttctcaaaaaactaaaaatagaactaccatataattcagcagtcccactacccgggatgtatctaaagaaaaggaaatcagtatatcaaagggatacctgcaactgcatgttttttgccacactattcacagtagccaagacatggaatcaacctaaatgtccatcaacaaatgaatggataatgaccatgtgtgtatatacaaaatgaaatactattcagtctaaaaaagaatgaaatcctgtcattcacagcaacatggatgagcctggaggacattacattaagtgaaatgtcaggaacagaaagataaagaccacgtgttctttttcgcatgtgggggtaaaaataaattgatcccatggaagtagagagtagaattgggggcattagaggttggaaagagtagaggggaggggaggattgggagaggttgcctaacagatacaaaattacagctagataggaggagtgaattctaatgttccacagtagcaggctccggcattttggcaccagggactggtttgtggaagacaatttttccaaggtccccaagggctgaggggatggtttagggatgaaactgttccacctcagatcatcaggtcttagcttctcataaggatcatgcaaactagatcccttgcatgtgcagttcacaatagtgttcgacaggaggcagagctctggcggtaatgctcactctgctgccgctcacctcctgctgtgtggcctgtttcctaacaaaccatggacttgggtacccttgttctatagcattgtatggtgaatatagtcaacgataatttattgtctatgttctaaaagctagaagggaggattctgaatgttcctaacacaaataagtgacaattgtttgaggtgatggatatgctaattaccctaatttgatcattatgcattgtgtatatgtatcagaatattactctataccccataaatatgtacaattattatgtatcaactaaaaataagaggaaaaaaaatccaaaacaaacacaaaaatcctgggtctggtacaccacctggctctctggttacctaactgatttacttttcttttctaaacagaacaccagagaattccaaaagtacatgttactatgttgccacccaggacacctctccaaaaagtattcctctttttgtcactttctagtatcagctcttttccagagaatccctagataaaccagaaccagtgtcttctctgcatttcacccagagccatgggctcataaccacccgatagtaccatggaatggggagcctctcccctggagggtgtttagtgctgtgaaaagaaggtccagaggcccctttcagccatgatggataggaggtgatgctgccttgaaagtttagccttgtctgttccaacaggcccacaccctcaccctcatcccctctaaaagaactgggccttgtggatctgtaagcctctcaccactcatgcagaccctaggggcaaagccattcggctgctttagtttcttagctttttttccctccattgaatggaagtaggtaagaataggatgtgctcattccagcccgaactctgcttactttctaaagatgtggccaagggaatcatcatttattaattatttgtagctcgtggataaatggggaacactgaggacgtgtcacacagagctgagtggtggcctacatcagtcctgggagttgaatccacagccttctgtgagtgaccaggacaacagcaggctatagccttggtctcagggctcctaggagaagtgcacagaccatcactttctgccttgaggagggagagccacaggatgttgacctccctgcctctctgtagggactgctccagaaatgtgctttcccaggtgggataatcaggacatcctcacacagtgtgccaaggccctggaaatgatgtagatgtatagttgctggaagacagttgccagtaggagtggctccatgaagggcactccttaaacacacacacacacacgcatgcacacacacacacactcagccccaaggctcagagcagcctggggctgctctcactactggtagcttcactagtgagggttcagggccacttactctgggtgctgctgtgcccaagaccacaccactgagcccattcccacgtctgatgccaccttccttcctattccagcaaaatcacatttactaccagagctcctttacaggtattagtcgtaactgccaccaggggacagcagcacagtatacttgctgtctatgcagactgggaagctacctggtgaaagaggttttctgggcctttgtagtgagtcttcagccctgagtgtccctgaggacagggccattttacacactatgaccaatccaatgtgactgggacttatgagctctgcaagagccaacaaaaatatttgaatcaaaaataaatagataggggctatgccatgccctgtgcgtgagcagctgcagcggcagaggcagcatccagaggtggcgccagcagttccagcccgttgctttactttttgctrcaccgacatagccactatgcagaagagaaagtctccagagaatacagagggcaaagatggctccaaagtaactaaacaggagcccacaagatggtctcccagattgtcagcaaaacctcctccaccaaaacctggacccaaaccaagaaaaacatctgctaagaaagaacctggagcaaaggttagcagaggtgctaaagagaagaaaggaaaagtaggaagctggaaaggaaggtactgcaccagctgaaaatgatgaaactaaagctgaagaggcacagaaaactgaatctggagataaccagggagaataaattgtcatgaaaaacaggttaattttatgtatctcttaggtgaacttttaaaagctgtttttactaagtattttctaaatgctaattttttaggactctactagttggcatacaaaaatatgtaaggatggacattttaccctctcataatcatgctttttggacatttccatcatcctcaagtaaaataaatatcagtttaatattggaaactgtgtgtaagattgattcagcattccatgcacttgctttaaaatttagtcctgtgtatactgtggtgtttttactgtgcatatttgagtttttcatgcagtttttctttttcttttattttattattattawactttaagttttagggtacatgtgcacaatgtgcaggttagttacatatgtatacatgtgccatgctggtgtgctgcacccattaactcgtcatttagcattaggtatatctcctaaagctatccctccccactccccccaccccacaacagtccccagagtgtgatgttccccttcctgtgtccatgtgttctcattgttcagttcccacctatgagtgagaatatgcggtgtttggttttttgttcttgagatagtttactgagaatgatgatttccaatttcacccatgtccctacaaaggacatgaactcatcattttttatggctgcatagtattccatggtgtatatgtgccacattttcttaatctagtctatcattgttggacatttgggttggttccaagtctttgctattgtgaatagtgccgcaataaatatacgtgtgcatgtatctttacagcagcatgatttatagtcctttgggtatatacccagtaatgggatggctgggtcaaacggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcattgtggttttgatctgcatttctctgatggcctgtgatggtgagcattttttcatgtgttttttggctcataaatgtcttcttttgagaagtgtctgttcatgtccttcgcccactttttgatggggtcatttttttttcttgtaaatttgtttgagttcattgtagattctggatattagccctttgtcagatgagtaggttgtgaaaawtttctcccattttgtaggttgcctgttcactctgatggtagtttcttttgctgtgcagaagctctttagtttaattagatcccatttgtcaatgttggcttttgttgccattgcttttggtgttttagacatgaagtccttgcccatgcctatgtcctgaatggtaatgcctaggttttcttctagggtttttatggttgtaggtctaacgtttaagtttttaatccatcttgaattaatttttgtataaggtataaggaagggatccagtttcagctttctacttatggctagccagttttcccagcaccatttattaaatagggaatcctttccccattgcttgtttttctcagctttgtcaaagatcatatagttgtagatatgtggtgttatttctgagggctctgttctgttccattgatctatatctctgttttgttaccagtamcatgctgttttggttactgtagccttgtagtagagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatgtataaattaccttgggcagtatggccattttcacgatattcattcttcctacccatgagcatggaatattcttccatttgtttgtatcctcttttatttcattgagcagttgtttgtagttctccttgaagaggcccttcacgtcccttgtgaattggattcctaggtattttattctctttgaagcaattgtgaatgagagttcactcatgatttggctctctgtttgtctgttattggtatataagaacgcttgtgatttttgtacattgattttgtatcctgagactttgctgaagttgcttatcagcttaaggagattttgggctgagacaatggggttttctagatatacagtcatgtcatctgcaaacagggtcaatttgacttcctcttttcctaattgaataccctttatttccttctcttgcctaattgccctggccagaacttccaacactatgttgaataggagtgatgagagagggcatccctgtcttgtgccagttttcaaagggaatgcttccagtttttgcccatttggtatgatattggctgtgggtttgtcatagatagctcttattattttgagatatccatcaatacctaatttattgagagtttctagcatgaagggttgttgaattttgttcaaaggccttttctgcatctattgagataatcatgtggtttttgtctgtttatatgatgctggattacatttattgatttgcgtatattgaaccagccttgcatcccagggatgaagcccacttgatcatggtggataagctttttgatgctctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattctctctttttctattgattagaatagtttcagaaggaatggtaccagttccttcttgtacctctggtagaattcggctgtgaatccatctggtcctggactctttttggkaagctattgattattgccacaatttcagagcctgttattggtctatttagagattcaacttcttcctggtttagtcttgggagggtgtatgtgtcgaggaatttatccatttcttmtagattgtctaatttatttgcatagaggtgtttgtagtattctctgatggtagtttgtatttctgtgggattggtggtgatatcccctttatcatttcttattgcatctatttgattcttctctcttttcttctttattagtcttgctggtggtctatcgattttgctgatcctttcaaaaaaccggctcctgaattcattaattttttgaagggttttttgtgtctctatttccttcagttctgctctgattttagttatttcttgccttctgctagcttttgaatgtgtttgctcttgcttttctagttcttttaattgtgatgttagtgtgtcaattttggatctttcctgctttctcttgtgggcatttagtgctataaatttccctctacacactgctttgaatgtgtcccagagattctggtatgttgtgtctttgttcttattggtttcaaagaacatctttatttctgccttcatttygttatgtacccagtagtcattcaggagcaggttgttcagtttccatgtagttgagcggttttgagtgagattcttaatcctgagttctagtttgattgcactgtggtctgagagacagtttgttataattcatgcagtttttctagatcaataatcagtggtgcttttgtacctaggttttatgtgattttaataaaacatggatagttatggccacctgctgacaatttgaggtttaaaatatttaaaatgtagatatctttccataggtatacctgtgtgtcagctccaaaataaatgtgcaatggaaatctataaacatttaaatttaaatgtctagatataaagctctgtgaatctcatttattgttaaatttagtagtaataaaaaattcttacttgttaagcaattttaatgtatatattttttcaaaaacgtgctctgtagttgcaaagaagtcatagctaaaatgaggcaaatgtacaacttatgtcctaattccaaaaacaaaactataaaatttttttcaaaaaattgtcagcaaaaattgtatttaagtggtctgtgtgtacattttaatgtgtttgatatgatttggaaggatgattactctatcctttgaacaaaatagagtctgtctcagaaagtgtaaatacttcattcccatcaagtctctgtattttccacaaattttccctcttgtctaaaataacgtgcacattttttgaaagaagcctctatgtgcaaactttaaaagtcaaggatggccagtaagtccctacaggagatggagggggtgggcctgagatggagcagcctagttgccttgaatgttacatgaatgcttaaacaggggtttagggcccctctcttaggcctctgggctctgaactactttgagagaacatccttcttgagtcatagacacatctgtcaaaccttaactgttgaaaggaatggtcactcataatcttcctattcttgcaaggtcctaggaacatggatgctgagatggtgtcttctccatattttcatggccagacttcctgttaaggctggaggtgagaagtggaaggaccactttctacggcttcctccccagcccctttggatggatcttcatacactctggtgccctttcttatctgtgaggtttgacctgacactgagttgagagtccgaggacctgggtttagtcctatttctgcctctttctttctaactgcataacttttgacaacactaaagaaactccattttcttatttgctatgagcttgattatgtctatgtttccacagtcacatgtctgtgtagggattatgttaatttatgtatgtgacaggaaagattaggatattcaattcctttaacaaataattattgaatgctaggcactacttcagacaccaaagcaacagcaggaacaaaacaggcacatgtagtattgctgaactgtaccaaattcctctccactgaggctcattttgcattcccaccagaaggtgtgaaaatgcctgctttacctcatcatcatctattctcaaacttgtagatttttgtcaagctgatagtgagaatggtatctcaaactagtatagttttggtttatgcttctagtattacaaacaagctttagcatcttttcatatatttaagcatcatttgtattttttgtgagctatctgtttgtatcttttgcccattcttatttcttattttgtgtgtttgtgccttcttaccccacctttttcactcttttcaaaattaggttggtttttctacttgttgattccaaaaaaaaaaaaaaagaggattatctattcatttacttacttatttagttgttgactgttttgtgaacttatacttttattaatttttatggggaattcatgtagctgtgttctacagatccttatatgtctaatttaattatcattttctaaaaattctgcaatttcattttattttcagttccttttattcaacagttttaaaataatatgtgtgtgtgtgtttatatatatgtttttaatttccaacaacaacacagatttggtaaaatccatcactattacatgttcttttaagaatgctatttgtggccaggggcaatggttcatgcctttagtctcagcactttgggaggctcaggagggcggatcacttgagctcaggagtttgagaccagcctgggaaacatggcaaaactccctctccacaaaaaatacaaaaattagccaggtgtggtggcaagggcctgtaatcccagctactcgggaggctgaggcaggagaattgcttgaacctgggagctggaggcagcagtgagctgagatcataccactgcactccagcctgggtgacagagtgagaccctgtctcaaaaagaaaagaaagagagagagagagagagagaaaaagagagagtgagagaaagagagagagagcgagagagacacaagcaagcaagcaagaaagaaagaaagaaagaaaggaagaaaagaaggaaaagaaaaagaaagaaagaaataattctattattattattattattattgagacagggtctccatctgtcacctaggctggaatgcagtagcacaatctcagctcactgcaacctctgcctcctgggctcaagtgattctctttccttagcctcctgagtatctgggactataggcatgtgccatcatgcccaactaatttttgtatttttctttttgttgaaatggtatctcattatgttgcccaggctggtcttgaactcctgagctcaagcaatctgcccacctcagcctcccaaagtgctgggattacaggcatgagccaccacacctgggcctatttctatttttgaataatgcattgaagttttctttgtgacctgatattgaatatttcatgtgtagacggtatagttttttcttgttaggttaatacattgctggactatatgtctgtagagttctttatatcttattgaatgtactgtttcttctctacacttactgtcttgagctgagagagatgattaaagtgccctattattactatgttattttctttaagtttttccttgtatctcttatagtttctgtgtcatcagagttgtgctacattattgaatgcatagatattaaaaaccattatatcttcattgtgaaattatagcatttggcattttaaagcttccttcttagtcttatttaatgccttttgatctaatctgggatcaagatcatgactcctgatttctaaattttgttttaacctgcattttcctgatatatattaactcaaccaccctgtttacaaattgttttctgactctctttgatttgcacacctcttgtaaggagcatagacttgtatagagctaatatgcaacttgttcatctagtagtgagttaagctcttgacattattgttataaatatgtttgacctcagtctatcacgctcttttatgtcctatttatgaaaatatgtatcttttacataaataacatcatccactctgttatctgtgttatttgcttttttctagaatgtcttttggtgttgaggaaggtttgtatttgtgttgttatcttatagtacatctttatgtaatatgtattctgtattcccccttccctttaataaatggcatattcactccccactctaagtaatgatggaattttctggaaattttcaccttaccctccttcttcctttctcagtatctaatgtgaagtgatatcctttcactcccagtttttccttgtaagcatatgcttatattaagacaatcagggagctcattctactttctgtatgctttctctttctcccttcatttttttgttagctgtattgtatttaaattttcagtgcatataacatgaaatgctattctgtcacctttatccacattatgtagtcttagttctacagtggaatatatttaaatgtgcatcatcagattgtatgccaaacagttctgtgattctgggtttagtgtgtatgtatgtgcgctgattctctagtagattccccagaaagggcttatgggagcaatattccctgagtctttgcattttctttgctgtttttctttggcctttatgcttataagccagcatgaattgatataaaatcaatttgtcctcagaagaacaaccttgcctttcacacattcaccctttactactctggctccagctctaggtttttgcttggtgtgttagttttctatcactactgtagcagtttaccataaacttaatgccttaaaatgacaaaaattttattctcttacaggcctgaaggtcaggagtctaaaactgaggtggcagaagggctatgttacttctgaaggctctagaggaaagtgtcttgcatttccagattctattctccacacattctttggctcatagcacatggctacagccgctggtttcatcaccacacttccttttactgactttgatcctcttgtctcactcttgtaaggaaccttgtgattatattggactcacccagataatccagaataaccccccaccatctcaagattcctaacttaatcacatctgtgaagtccctttcttgccatataaagtgacatattcacaggtttctgagattaagtcccggacgtctttggaggttgttatttagcctacgtgttgtttttgtttggttgttgtttattccacattttgttttttccttagcgatttcccttacttcctgtaaaccagtaacacagtgaaaaaaatgctttatgcaggatctagttattttgtcttgggaaatctttcagattatctagtcttctgtactgacaaaagcacaagacccccaagaagtttctaaacaatattaattggctccaaaccttagaaccagcatctgtagggttaggtttatacatttttttttttttgagatggagtcttgctctgttgcccaggctggagtgcagtggcacaatctcggctcactacaacctctgcctcctgggttcaagcaattctcctgcctcagcctcctgagtaactgggattacaggcatgtgccaccatgcccagctaatttttatatttttagtggaggtggggtttcaccttgttggccaggctggtcttgaactcctggcctcaggtgatccgcccacctaggcctcccaaaatgcagggattacaggtgtgagccaccacgcccgtccctataaatctttattttaaaactgttcttctggtcactcttaaaataaaccagaattgatagtctctaccccataacatggtttatatctggtgggtgagacatcatgagaggtcagagctgacactgagggggaggtaggaagggaagcacaaaattctggcccctggctcagtacctggtaacacaagctttctcgctctttccctacacagccactgggggccttcttccatttcttggtaatcttaaatcagctttcctgtgtgaccttacaggtgaatagcggtttaacgctatagaattagaggtagtgaaagaccaagaggaattttgcctatctatctaaatactaattgtcttttcagggccatcataaagaaagcgccttttgtatgaaacctttgctggtccatctctgccaagtattaagtatgatatatagcaggaatctcatataatattttctcaactagttgctcttcaaaggtagggactatgtccagttcatcatctcataactctacagcctttggcctgtaatatcaatagaaggtggttgaatgagacacagaggccagtggcttaaggttttattgatgcattagggtagatggggcaatagagagatgtcagagataaaaatagtcctgaaaccccccacaagatgaggacaattcagtacaaaggggtgacttgctctgagtcttcctgctcctgagagggtctgcaccgcaaagcaggtaagaaagaagagttcaggatagaaagctccttgcagaaattatctcattgagaaagacctaaaagggaagctgcataatgaagagctgatgtccagggatgcacccactggattggccatgcaggacaagccaaactctctccagctgtcttcttccagtactggacattggagtcggggaagtcatggcttggtgcttctcaagtaggaatacagctctctagctgtgatgcctcgcttctcttctgactgggctgcatcctggccctgtg

SEQ ID NO: 10778 - DNA, 21185 bp, Homo sapiens
acactggctcattgtccctgggactgagcagcagcagcggcgggtgaggggcacccctcctgacctccagcccctcccaaccccgtggctattcggctgccaggccatcactgccggatcttacagtagcccccagcagcacctgaagcatcatgggaccccttcccccatggcatcttttaccaggggcccttaggaataatgcattttaagaagggataggtccaagcgcagtggctcatgcctttaatcccagcactttgggaggccgaggtgggcggatcacttgaggtcaggagttcgagaccggcctggccaacatggtgaaaccctgtctctactaaaaataaaaaaagtagccaggcatggtggcaggcgcctgtaatcccagctacttaggaggctgaagcaggagaatcgcttgaacctgggaggcggaggttgcagtgagctgagatttcgccactgtactccagcctgggggacagagcaagactctgtctcaaaaataaaacaacaacaacaaaaaccactcctgtgacaggcaaccacgtgtactttcactgatcctcagtcctccagggacatggtgtgcattggtcccattttactaatgcagaatctggggttcagagaggcgattaaatgcctgacccaggatgtagactggtagctgacaaaggctggatttgaaccctgacctgcctgacgcccctgtctgcactgtcgccataaaggcagggcgctccgtggagaggaaggcaggtactccagataaaagaaaggtggtcatggccacgatctgtccagcaaagcactggctgccgttgatcccaggccgggggcatgggcatgaatgaccttgccaggccctgcagccagagaattccaaagctccccccacctccacccccgcttttcagagcagagcattaataaaggggaaggagctggatgatgacgattcagaaatttgcagcccgagctaaatgagagcctcataatgatggtgattaaaaattcacacttctgtttgtacagcgatttgagtgtccacttagcaccatgaatcaattaataaacggaaacacaagggctagggataagctccagggcacagaagagggggctgtgaggtttcagaggggacatcccagggctggggcactgctttttgttgttgtacgatggggacactcgttggcttcaagagccatgaggtggggcagctcccccggcctcagcaaagcttaacaatcactcaacttctctgggtgtctgtttgctcatctgtaaaaggggtgaggtcggccaggcacagtggctcacacctgtaaactcagcactttgggaggccaaggcgggcagatcacctgcggtcgggagttcgagaccagccttatcatcatagagaaaccccgtttctactaaaaatacaaaattagctagtcgtggtggcgcatgcctgtaatcccagctgctcgaggggctgaggcaggagaatcgtttgaacctgggaggcggaggttgcggtgagccaagatcgcgccattgcactccagcctgggcaacaagagcaaaactcagccaaaaaaaaaaaaaaaaaaaaaaaggtgggatcttccaaaactaaatttctttctttctttctgttgggacagagtcttactttgtcacccaggctggagtgcagtggtgcaatcatggctcactatagccttgacctcccgggctcgagggaccctcttgcttcagcctcctgagtagcagctgggactacaggcatgcgccaccatgattagctaatttttaaattttttgtagagatggaatctcaccatgttgcccagactggtctcgaactcctgggctccagtgatcttcctgccttggcctcccaaagggttaggattacaggcatgagccaccgcgcccagccttgaatctgaatgccaagtgagaaggtctattcatttcctagagctgctgtcacaaattaccacaaaggtggctgaatacaataggaattcattctctcacattctggatgctggaagcctgaggtcaagatataggcagggttggttccttctggaggctctgagggagagtctgtcccacatctctctcctggcttctggtgcagatggcaatctttggccatccacggaagctgggtcaccccagtctccacctctgtctccccatggccttctctgtgtcccctctgtgcctgtgtctcaattatccctctcctttctctcataatcacaccagttactcggtttaggaatcatcctaattccaggatgtcccatcttgagatccttacccgaatgacacctgcaaagaccctgcttctaaagaagttcatgttcacaggtaccaggggttaagactttgattttttttattttttatttttattatttttatttttattttttatttttgagatggagtctagctctgttgctcaggctggagtgcagtggtgcaatcttggctctctgcaacctccgcctcctgggttcaagcgattctcctgacttagcctcccaagtagatgggaccacaggtgcttgccaccatgccctgctaatttttgtttgtttgtttgtttgtttgtttgtttgtttttgagacagagtttcgctcttgttgcccaggctggagtgcaatggcgcgatctcggctcaccacaacctttacctcctgggttccagcgattctcctgcctcagcctcccaagtagctgggattacaggtgtgcgccaccacgcctggctaattttgtatttttagtagagacggggtttctccatgttgatcagactggtctcgaactcccaacctcagatgatccgcccacctcggcttcccgaagtgctgggattacaggcgtgagccaccgcgcccagccaattttttgtatttttaatagagacggggtttcaccatgttggccaggctgctcttgaactcctgacctcagttgatccacccaccttggactcccaaagtgctgggattacagacgtgagtgagccaacatgcctggcctttttttttttttttcctttgaagaaagggtcttgctctgtcacccaggctggagtgcagtggtgcaatcatggcttactgcagcctcaacctcctggactcaagcaatcctcctgcctcagcctcccaagtagctggaactacagacatgtgccaccatgcccacctaataattttttaattttttgtagagatgggagtcctgctttgttgcccaggctggtcttgcactcctgggctcaggtgatcctcctgccttggcctctgaaaatgctgggattacaggcgtgagccactgcacctggcctagacctagactttttgggtagccagttcaatttactgcagaaggtattttgaataagcaaaaactatgaatgcaagccccgttgtttgtgtgccaaactaatgatgagccactgggagaagggatttcatccatgtgacacccaccacacacctctgctggccaggcacctagaagtgggatgggaagcccccggtggaggagcagagaagctggggtgctggagggaggagtcttaaccaggagtctccttcatgttcatccctcatcaattaactcttgcaggccaccagagtagcagaaagatctctgggctatatccccagggctctcatgattttaaaaaatcatccccaggctgggcacggtggctcatgcctgtaatcctagcactttgggaggatgaggcaggcagatcacctgaggtcaggagttcgagaccagcctggccaatatggcgaaaccctgtctctactaaaagtacaaaaattagccaggtgtggtggtgtgggcctgtaatctcagctactcaggaggctgaggcaggagaattgcttgaacctgggaggcagaggttgcagtgagccgagatcgcgccactgcactccagcctggtcaatagagcaagactcagtctcaaaaaaaaaaaaaaaaaaaaaattcatcctctaagcagcccctgtccagtcttcccccgaccatccctcagagagccatgtacagttctcagagccctgtggtggctctgctgccttcacgatcacttccccccaaagctggccccagcaggccccccagagttgggtcccttctcagctcttaagcctcattgcccccattccacctctttacccccgcttctgccaaaccaaacccttgagcgcctcctcagccttcacattgctccatgccccaaccttcatactgctggccttcttccagaacattctctccccatcatcatgactctccattgagagagctctgcctgctaccccttcctgccctgctgggcccctcatgcctccatcgcattattgtgtgaatggctaatgtcccctccttgatggggccatctctgaggatagggacgtggccctagtgcagagatgctcagggatgtttagggaaggaagtcatcaagagacctagatgtgaaccccatccatagcgcctcccaaaccatgtggtcttggcctccctgggctttgattccctcatcagtcctgcctgcgctgccaggcttctgtgagcctttaatgagcctgtgttgacagatgaatgcattcttgggactactaatcaacgcatacaactaaggccaagagaagccagggtttctaccccagggacccccttggccccaccctctagccctggagctgggtccctctgcctctcccaggatgcagtcagaggcctgagcttctggaaactcttggatctcgtccctgctcctcccagtcccacctcggctccaggtgtctatctctccagctattttcttttctgatctggagttcaaaagaacagatctaggagcaacagccacggggaacaacagccagcaggctagttcatgttggcccagctgagagcctgcggggctgcccacctctccctgctgggtttgggcacccagaaaggagggcgtatgggttctggttctatgggcattaaaagccaatgtgactgagaacagcagctctagttagaggcaaggccagtttggggccagagcagggggagggggaacctggtctaattagagccctaacatgctcctttgaaagcattgtcagatgtccccagccctgcaggcaggggtggtgtaataataataaaacaacatttgcatagagatttcatttataaagcactttctcaggggtggggtggcactgggtggccctgtggaatcctggctgggaggccgccctggccttggtcggttccgccctcccgccaagctggcgattgtgtgcgaggtaaacaaagcgccattcatccaactgtttcagttcctctcctcttcattcctttttccctgtctcccacgaagagctcactcggggcttgtcactcaggccagaaaaggggtgtcaggggccccagagggagaccccttccctcatgggaagaagcggggaggtgggacggctccctccctctgcaaacccccaccacccccagctctggcagaataacagccttgctgcggttggtttgtgcaactctttgctaacctgtggctgtgtcttcatggacaaagtatgagcccaggtttggtaatgtctgcgtgcacgccacgtttgtgttcggtaacatgcagagataagcagtttgtggggctctgcgaatccctccctatccgagtgggccttgtgtacacagtgtgggggtgaggggccctggggtgtctgcccctgcactgggtgggccgggtgaggcagctgggccctgctcctgtacagcccaggctggagcgtcccctgcagtcacctggccactggcaccctggggtgaagggggaggcattgggcgctggccccttaagggcctctgatgagctatattgggcccacctgcctgggttccagcagcttccgcagccccagcaggagacggaagatgcaagaggtcattgcggggctagagcggttcacctttgccttcgagaaggatgtcgagatgcagaagggcactgggctcctgcctttccagggcatggacagtgagtgagggtggggccactttccctcccctaccttctctgtttttttttctttgagacggagtctcgctctgtagcccaggctggagtgtagtggcacaatctcggctcattgcaagctctgcctcctgggttcacgccattctcctgcctcagcctcccgaggagctgggactacaggcrccygccaccacgcccagctgattttttgtatttttagtagagaccgggtttcaccatgttagccaggatggtctcaatctcctgacctcgtgatccgcccgccttggcctcccaaagtgctgggattacaggcmtgagccaccacgcccagcctccctcccccttccttctctacaggcctctctgctcaactccctgatgcgaccgccccttctctgtctctctcttctgtggcttcggggcaacccattttccagactgagaaagagaggcacagagagacggtgaattgagagaagccacactggcctcccgagctcctgggccaggcttgagcccctcgagctcctctgtttcagagttggggggttaagggttgaggtctgctggctggctctgcaggttaacctctacagggcccagatttgggatcccataggccagagcctgggggaggtctaggtgggacatgccgatggaggtggaggcttccggaacagctgcagcctctggggaagctaccttctccgttccctcttctccttccagagtcggcctcagctgtgtgcaacttcttcactaaagggctctgtgagaaaggtgagttagcagacaggcctgggccccaagctgggtgagtgtagggtctgtctgagctacacccagcaggggctctgcctggcctgggatagggtgtcgaatttgcacctggggagggaaaattgggatggaacggaattttatttttattttatttatttatttttagatggaatctcgctctgttgcccaggctagagtgatctggcgtgatctcaactcactgcaacctctgcctcctgggttcaagcgattctccttcctcagcctcccgagtaactggaactacaggtgcatgccaccaagcccggctaatttttgcatttttagtagagatggagttttgtcatgttggccaggcgggtctcaaactcctcacctcaggtgatccacctgcctgggcctcccaaagtgctgggattacaggcgtgagccaccatgcccggccatggagcagaattttagacttacaggtagacaaaggataagtggttggatccaccgagcagcctgcccctcccctaagattttcccgcctcagcagcagtcttcatagtttgcagttcgcatcagggtaaccaggctgcctggaaaggggtatttttttctttctgccttgctgggatgggcgtgtgtctgagctttggcctgtgcattcccaggaggctccagcttcttaatgtttttcttgatttcctcccagctagaagagaggcatccttctcccccagtcccctgctctgactcagtttgtaaactggtcaattgtctcatccattccctatgccctgaggtagcacctgccaccatctttgaaatgctatcaaaaagcatcctccacttctctcctgccctgactttgggtcaatactgtcttcctaggcccctctccccaaatgcagccattctgggaaggcctgattcaaatataagagttttcaacttttcttctggctcatggctcatgtagaggctctttcaacagaaatatacaattgccaaaaaaaactggcttccagttttagggtttccctgtcttcctcccgcttgcctatacatttaggttaagaaatctcactggtgtgagagtttaggacatgttttctgatccaaatgagtctgtccctggaagctggggggctggaggggaccaggaaaggaggacctggggccatgttcgcccacctgccttgtttgtcttggggccagccctagaccatacagggagaagggaaatgggatcactggtcgcccaaggccttgtgcacccaggaccctgcaggctcaatgtggactgagtggcatctcctcagcccagcccaaccagdccctagagcagtggttcctagcaacacccttctgcaaagaaagaaagctattatggtggaaggtcagaaccaagcaagtcaatagccaggggtggaggttaggggtatttaaaaagagcaccttggccgggggagtaggctcacacttgtaattccagcactttgagaggcagaggctggagaatcgctcaagaccagcctgggcaacatagcgagaccccatctctacaaaacataatttttttttttwaaaaaaggaaaaatggaaagaacacctcccctagcccccaaattatgtcagagaactggccaggcatgaggctggacctgcttagaaactcaggaactgccagcctggatgacatggcaaagccctgtctctacaaaaaataaaaaaattagctcagtgtggtggtgcatgcctgtagtcccagctactcgggaggctgagatgggagaactcctgagtctaggaggttgaggctacagtaagccatgactttgccattgcactccagcctgggcaacagactaagatcctgtctcaaataaataaataaattaaagaaacttaggaactgggtgtccttcctgctaatagcaaggcagacttgagtgaagatgataaagcagttaaatgtaacatttccatggaatattccttataaatcattacaaagttggctcttctgtcaccctgttaggtctctggaatcgggaagcataacatttaatgtttttaaagatgggaattcaacacacccttactgagcacttactatgtgccaggggctgggctgggtgtggggattctgggctggaaagcctggccccgctccctggcaggacgagagggggtgttaggcactctgggaatgaaaaggaggcagctgttctgagcccaggtacttccctggagaagggcatggcactccaggcagatgggaaggatgggcaaaggtgtggtagtgggaacagctgtgctttaagaagagcttgccctggccagtcacggtggctcaagcctgtaatcccagcactttgggaggctgaggcggatggatcacctgagatcaggagttcgagaccagcctggccaacatggtgaaaccccgtctctactaaaaataaaaaaaatagccgggtgtagttgcaggtgtaatcccagctacttgggaggctgaggcaggaggatcacttgaacctgggaggtggaggttgcagtgagctgagaccgtgccattgctctctagcatgggcaacagagcgagacgccatctcaaaaacaagagcttggctgggcgcggtggctcacgcctgtaatcccagcactttgggaggccgaggtgggcagatcacaaggtcaggagatcgagaccatcctggctaacacggtgaaaccctgtctctactaaaaaatacaaaaaattagcagggcgtggtggcgggcgcctgtagtcccagctactcaggaaatggaggcaggagaatggcgtgaacccaggaggcggagcttgcagtgagccaagatcgcgccgctgcactccaacctgggcgacagagcgagattctgtctcaaaaaaaaaaaaaaagctctcccttcatgctgcctcggctcccagttccagcccctacagggtccaggtgaagggataaggggacagccgctggggactgagtcaggtaccctcctggggaatcccctggagggctgagctgggcccaggctgtggatgaggggcctcccagccaggtgctctggcatctccagggaaactctgccccttccgacatgaccgaggggagaagatggtggtatgcaagcactggctccgggggctctgcaagaagggtgatcactgcaagttcctgcaccagtatgacctcaccaggatgcctgagtgctacttctactccaagtttggtaaggcctcttcctggctcggtgcctcaccctggagggtggcagtgtgggctgtgagatgggaaggtttctagaggagcgggcacgcagaggaggctggacatgtccctggaggccagagagacctgtctgagtctcaggtgtctgttctccaaacccctagacaagcagaagtgcaccctgaagtccctgccctttactgccccctggatcaaggtgcataccagatacccccaaaagggaagaagggattgtttctctccccattcttggttcatcacacacccagcctgactatattgaaatgtctcaaatgagccatctctcaggccccggctagaacttctcgaatatcaggccttcagagccacatkcacgatgcctgctgtaccctcaaagccccagcaccactgtctgctcttccaacggtcttgctattttaactcttactttagaagaaactttgcattgtttccataaacggagaactagcatcacttgttggaaatcaaaggtcattgtaaacataaatccatgaggttcagaggtctagcacctaaagtcatcttgtgcggtcaagcctggaccagcatcttacctccctctggcttcaaggcatcctttgtccttttatttatttttatatatttttttgagacagcgtcttgctctgtcccccaggctggagtgcagtggcgtgatcttgactcactgcaatctccacctcccgggttcaagccattctcctgcctcagcctcctgagtagctgggattacaggtacccaccaacatgccyggctaatttttatatttttagtagagacggggttttgccacgttggccaggctggtcttgaactcctgacctcaggtgatccacctgccttggcctccctaagtgctgggattattggtgtgagctgcagtgcccggcctcctttgtccttttaatcaagggactgtttatggggcagctgcagccactttcccacttacttaagaaaggaatttgtaaatgtgcttcaggtctcacccttcacaatacgattctacagctcagagcttttcggagctggaaggagccttacggattatctagtccagtggttttccaactgtattccataaagagtgacctacaaagagagagctggcagaatcccctggatgcccctgactcaggaggcttggcttccaaatgtggctgcagccagcttcagggccccccaagcggctgctcctcattagtgccaatgggagggtcctgggtacctgagaaggaggcaaagcattgcctaggccagtcagagccccacccaggctaatattccatttcctgcctgctcctgggaggcaaaggcatggcagttcctgagagctgcccccatgtctcccctgaaaggacaatgtttatccaagttccccttggtcactgcctagcattctgtgactttagtaataaaatgccacctacttagttattccctcaatagccytcggtgtttgtttggggatcaggtgctcctgggcatggatacaggaacaggaccaggtccccctccgcccccagataactccaattagtagaggacagacttgtaagcccatgattacaagatgtaatctactgttcttacagtaaatgaatgcatatggctttcgaatatcaaagtgatgatcactctaattggaatcagagtgttgttggggaggtgtaggagtgggacagagtcactggaagggactggtgtccggggtcttcagcccagtacccccgtctctgaaaggcggattgaaggctgaggtgctgctgccacctgctggccaggccaggaatgcagagacgtgcacgcagcagaacggcaaccagtgtagatgactttctgttatctccatccatcaaatgctggccagcatcacctagggggtgatgtcactttgattcattagaaagctcaagcccagagtcagcactctgcccagtgctgtatactgacaatgaacaaatgaacccttcatgaacgtgaggaagctgaatgaaatggatgtggccttttcccctctctgagccctggcgttctctgtgaaatgagagggctgggaaagaatggtggttttaaactcttaggaatcaggggtactctccttttttttttttttttttctttttttggagacagagtctcgcactgttgcccaggctggaatggaatggcacaatctcgactcactgcaacctctgcctcccaggttcaagcgattctcccaccacagcctcctgaataactgggactacaggcacgtgccaccatacctggctaatttttgtatttttagtagagatggggtttcaccatgttggccagtctggtctcaaactcctgacctcaggtgatcctaaggatcaccacctcggcttcacaaagtgctgggattacaggcatgagccactgtgcctggcctaggggtactttcctttaggcgaaaccttgctctgtagaggcccagtgtataaaatagatcttcctggagcaatttgaaaatcagtggaatagacgctacgacgctccttcagctctgaaaagcactgagctgtagacatttaaggaggatgaagttggaaagattcatgagttctcaacttgaatgaagtgaaagtgggatgaatcttcccccatgcttccttcagagctttcttcctaagagaaatctaagagagctcttaaaatgacacctgggtccgggcgtggtggctcacacctgtaatcccagcactttgggaagccaaggtgggcggatcacgaggtcaggagttcaagaccagcctggccaacatggtgaaaccccatctctactaaaatacaaaaaattagccatgcgtggtggcacatgcctgtaatcccagctacttgggaggttgaagcaggagaattgcttgaacccgggaggcggaggttgcagtgagctaagattgcgccattgcactccagcctgggcaacagagtaaaaccctgtctcaaaataataataataataatgacacttggrtagcctgggcctactgggctggctccctgtaggaaataaactaaacctgagacttggtctaatccatagagagatgatgacgcaggcttagtataatgcaggtgcccactctgtagaatgtttcttttcatacctgtgccaccttgagcagggctctgcttttctttgcatttccaccaaggggaacagcttccctaggctctgcaggcagcatgggttttgtagtagagawgaagagggggctgcagttacagcgacatggaaatatctccacttaacgtcgcaggccttctcggctctccttgttcctgctagcctctaatggccttcagttccagtgcctccttctccatctggggtcccccactcttactcttccagaggtgtatattcagaccatgccctgcttagcaaataggactgggatccaccctttttagactgcagcaaggattaggcatactttccatcttcaaaaagctggtgactcccagaataaaggccagtgtcttctgtgtttgtgaggggcaaggtcaatctggtttggggacacagaagtgatcacaaagagaaactgcttctacagagagtgctgggattttcaggtgactgcagcaacaaggagtgttccttcctccatgtgaagccagctttcaagtcccaggactgtccttggtatgaccaaggtttctgcaaggacggtgaggccttggaagccagggagccctaggggctgtggggatcagggtgggagctctcagcaggggaggggccattttcctgatgaggctgtgccttggagaaaccccaaatagaaggcctttctgtagttctcctccagctctgctgtgacacacaaaacacagcctggtgtggggccataacaggcttgaggcagactgacttgggttcaaatcctaccttcagcatgtatcagctgcatgcctttctccaagttactgaaccacacaggaagctcttgacacagggtcaggcccataggagacgcttagttcatgtgtgctctcttccgcattccacttacccacctggggggtcctgagtgttgcttaagyatgtcctacctttcccattgctgccagccaaatttaagaggcagcttaccccagcagggttcccatgccctaagcaacagggtttctccctctcctttgtcttcagataggtttttcttacggagttcttagtgctgttggttttagggatctgggcgggggtgagggctgctgagaagatcagtaggattgtggggttagcttttttctttctatcacccaggttggagtgcagtggtgcgatcttggctcactgcaacctccacctcccaggttcaagcaattctcctgcctcggcctcccaagtagctggggttacaggtgtgtgccaccatgcccagctaatttttgtatttttagtagagacagggtctcaccatgtggcccaggctggtctcgaactcctgggctgaagtgatccacccaccttggcctcccaaatgctgggattacaggtgtgagccaccccacccggccaggtcagctttttctcagctgtacctcccatacttaaataaataaaaggcaacaaagtgtggttcatatccatgcaagtcctccaggacacagcatgtcagtgacatttccaactctatttcagaacttgccagctgacacctgctccagcacattccaaggttccttttccccatccctgtctcatggctagaagtggatgctttagggtggtacagaaaggatgggaagatttatccacccctattaagtgaagcccctatgaccatccacacccttcctagggagctttttcatgtgtgttttcccctcttgctgaagcggatccttctcatcactttctctttgctcagcaggtcctctgtgtaaataccgccatgtccccagaataatgtgtctcaactatttagttggcttctgccccgagggacccaagtgccaatttgctcagtaagtatgatccctcagttaccaactcccaccagagtgctaggcctggccttctagttctagatctttccataccttcgctggtccttagtggaaaatgaagcatctggcaagcatccgctccagtattttcctggcaccactgcctgaccctggcaatctcagaactctaacccatcctcttaatgtgtattcatgctggggataggtgtcgatcttttcacaaactgttctagtaataagagaagaaacacttaatgcccatttctccccagtcctctgtaattctccctcacgccctggctaagggagggcaacttccctacagggttctgaaatatgaaatctgcagcaggctggcgcagagcatgttaatgagcagaagatgggagggcgagagctgggctgtaatcgtctctctctccacttcccttagtcccaagatgaatcttttactcaacccgagttacatgaaggtgagtgcaggcaggcacgtgccgtcatccctcatccctttattcccactcctttctgctccccagggaagctcacccagcagcactgcatggttcccagcgaaccctcactctcctttgaaaggcatgtcatcatgcatgtgggacacatatatgtggttgttcctcccagactactctccaacctctagaatctctgctgtgggtagggtaggacttctctgttgaccagtccaaggctttccttctgctagctgggtagcacgcatggtttttggaatcagggctggccctgattgagaactgtgctcagtccctatggagagacacacacactctatagacccaagtgttgatgagcacctatgtcaggggttggtaaactacagcctgtgggccaagtccagcctgctgcctgtctttgtacaggcgaggggctaagaatggtttgtaaaaagtgggaggaaaatcaaaatattttgtgacatgtgaaattaattccagtgctcataaagggttttgttgggacatggccatggctgttctggtgcttacaatggcagagtccagtggctgcaacagagacccagtagcctgcagagtataaaatatgcactgtttggtgttctatagaaaaagcttgctgacccctggtctagatgactgaatgttggacacctgtttaagtatcacagaggccagacagcgccaacactggggcagctactgacggctactggggcctccgagcactggatgctgggagggtgatggcctgggaggaagacagtccctgctggttctgagcaggctttgaaagaaggtgggaggcgatctgtgggactgcggggaatttacaagcccatttacaatgaaagcctaactttgatggaaaggtatgcttttggcacttaaaactgtaactaaaggcatcttgaaccctggtttcaccctaaatgcatggccagcgtcccggccctctgtgaagttggtgtctgcacacagggactatctgcagtaggtgttttctcacgactgcacttcagctgtagcttgccagccggccccgggattcagcacctcctatttctgctgtggaagcttggaaacccccatccccaacagagtgcctgctctcctgcctggggatcaggggtcaagggcagggcctgtgccacagggtggacaaaggaacccacagggctgggctagtgcttggctgagagctgggagggcaaggaatgatcagggagctggagaatgactccttttctgcagcagataggagtgtgaattaggggagaatgagaggatactgtaaaccatcctgttggcatctcctgctagacaagactgttcctgcaaaaggaacagtcatttcccactttgttgcctactactcttcagttacttgtacataacgtccttaaaattcttctttggcaggagggcagagtatggttaagggagggaacgtatcacctggttcctttttctggtatcttctggtttatcagaaagaaaaaaaatcatgtttgatcatatcttcattctcatagcttctaaactgtcctgagctttgcagtctccattctgcaagagaatagttttattgggatgacaggtaagagtggcagaacccttgacttttcttgtacagttgcttttatgtgccagcctcgttctctgggattgtgatgctgggcttgaatgcctgaaataagcttcaccaacaagcagaatccatccaattcctcacaaaggtagctaaccatctcctatggttccctagacatctttagaaatctgaatttacaaaaagtcatgccattcactttttctgtttttgtgtcaaagaccaggccattatgccagtaagtacagtaagactcaactgataggagttattaaaaactaacctatggtcaggagaagatgctcaatggtcttactatgggattctgtttcccaagttccacagtaagcctgctgtcatcctaagcagggtatgagtgaggtgcagaagtagcctgtggcaggcaggtttatttcttttgatcctgtaagtgaacgagctactaaaaatacaacaggtttggaggcagattggcaggaacgagttatccataaaacgggagcaaaatgtacataaaaccaaaagctcgagtctatgggaaatccacgatcattatactttgctcagctcctaccaacaggtctgggttgcacgtggcagctcctctgtatatggcttcagctgccgctatcaactggcaattaactcaaatggctttctttagcatgacagctgcttccctgtatggcttatttaaatctaagaatatactctgtaccttatgtgtggagtattatggggcagtagatggaataaaataggcttatcctggggaggtaaggtagtaacacaaaaatttaacggtattaccatcttttaatgccatcatgaaaggccaataccaagcaacttaatccactgggaaagggggggtagtggctgtgctgagccttttggaataatggagaagagcaatgggatgtgtgaggaagaactggccccccaccttggtaaaaagacaggtgcctggcctgcctggagctggagtccccagtcagggcagtctaaaagaatggagcccaggagtcgggttttggggggttgaatgccagttcaaaccaatgggggctgctatgtgatgaacagcacagagctacgtaggcaaatcactctacctcaagcccgttttctttttggaaaatgagcaggatagcacctacgccacaggactgtttgaaactaaaaggagaaaacgcatgtaaaaaaccttgcatggcactcggcacaaagcaagccccagatgttggctggatctgcctgtggattgcagtagggcctctcttcctccgttcaaggttggaatttatatatagtatgatggcacatactacaggctttagaacagctgctgtcaatgagttgctaccatcacagacgttgctggaattaacacatgtaagacttctaatctcaccaaatgtctgcaaagtaggaataattatccctaaattacagtacaaaggaggctccagtaaactgggtaacttacccagggacacacccacccatttcacaggtgaggctctagaagaggcaaataatcagctcaggggagtactttttatattttacaaataattttattatgaagagtggcggaagtagtatgtagatgccccataaagtataaaagagtctgctgataataaaatgattttatttttaacagctaaaataaattttaatgtgcattagaaaaactacacattcccaagtaaactcagtctttcagatattattcaggattaaacaaggccgccccgaggttaatccacttacacagaccacgtgtgagttacagccggggtattcaggcatgtccgtgaatattcccaacttgtagtaacagaaccttcaaatacgtcctctcaagcatggacagtagcctgggtgtcaccatgcctcttctgcgggatggatgggaaggtgaatatggattacgtgtatggattctcacgctgcatttgtatgcaccttgcaggaagattcgggaattcaagctgctgcctggaagcaagatctaagcattgcttcttacctagcggggcactccaatgccacagacagggcagaacacgacttttaccccctccttctgcagcatgattttaagagacaaaacttataaggctgtttaaaatggtaaatcatgttagagacgttctttttctttccttggctctgtgaagagatgagtagttaccccgcctcacacctgaagcgtactggcttctgtgggtagcagtcttacttgtctactattcgttctgaggagtcttgtctttctggatgaagcttttaatctggtgatcacatacatgattggaactggctgtgcaaatgaactgataggaattttgcatacatgagcgaaaaatgtatcctcacgaggcaactttacatcagtattgcaccctggagctgtgaagtgtgcttcctcgtcatgctgagtttgtttagatctaaatctcagaaaataatcagctatcactttacctcaacaacgctcttaaactattctgaacattaagaagagattcttgaaggacttgagaaaacatcttcaattattttcccaacccaggtggcagcaatgagcagacaaggaagcctttccttccattactctgtagacatttacaagtcatcccagaatgtggagatgtttccaatggcttcttgaaagttatccacactactgtattgtggattctcagtatctaattcaaagaagtcagtggagactttttgttgtttcctactatatgtgagttagaattcttggtacttaccaatgtcaaacaaaaaagctgtcttcttattaatacaggatctcacctttgccttaaacttggcaatacaaggcagatatccttttaggactcatggatcattaaatagttctattctcattaaataacttattttcagggatataaaatatttactgtgactaagttaaaccttttcattatgtttcagcaccctgattatgacaagtgatactactttatttatagcagtgatacaaatgctcctgataaccttgagggctgaaaagctatcccttaatgctaccactacacttaggtgttacagggcaattcagtgggcaacacagggcacgaaggcactagagagaagtcacgaaggcttctcctacttaaacgtgcttcctaatccaaacatgttttagagcggcaatccccagtcgtcttcgccacaccaatgcatggaggtactgtgctcttccagggcaggggtcggcacaatttttctgtaaaggccagatagtaaatattttcagcttttcagggcatatggtttctgtcgcaactactcgactttgctgttgttgtgtgaaacagccatggatgccacctaaccaaatgagcagggcttgtttttgtacattttgactacatacaaaaacaaggcagtgggctggctttggtccgtgggtcacagtggggtctgctgcccctgctcgagggaactgggggaccgggaaagagggtattactgaaggtcattctcatctaccttctcaccttgagagtttctggtcttgagtaaggacacatggggaggtgtggagagaatccttaagcatctctcctaaagagcattcacagagaatgggcacaaagctctttcggcagggaagattgttctgggttccaatgaagttcttagtaatattaaactaaaataactgaatgtagaactcttcccctcaaccacaacttttttccttacagagaattctaggatacagggatatattgctgaataccttaactatgagaatttgttgcagaattaaattactcccactagggatggaaaggagcaggggattgggaatagaaaaggtaggta

SEQ ID NO: 10779 - DNA, 13138 bp, Homo sapiens
aaccccagaggcgaagtttgcagtgagctgagatagcaccattgcactccagcctgggtgacaagagcgaaactgcaactcaaaaaaagaaaaagaaatctggtttaaattcaaaatacctctgccctcagtagcaacaattttgctccccacactacttgagcagattggccttgtaatttttttttctcccttcttattggctgttgaaggagttttcttgctttgtcttgttttgtttctttataataaactttcaatgttatctacctcttataccaagggaccacattgtctagtgagggtatcacctttctcattcctaagtttgcatccttgaaatcatactacattatttcttaatatcttggcctttttatatcatggaaaaaaataattttctaatctaatttcataacaaaaagaatacttttactgaggtacacattccaatattaagcatagcactaaatatggaagaaaaaatattaaaaaaaaaatagcctcaaattctcaaagattgacctgagaaaactctaaagttattgccttatctaagtgactgtaagtagtaagcttcatacccttgatgtgatgaaaaagaatatgaatacgaaatacttttaaaaacttattgataattatatttggagattatttttcattttaatttgccagggaagatttgctatccaaggcatatccattattgatttgtcatataggaacttggtgaattggaatagaagtaagaataaccagtttattgaaagtaattagagttgctatattctgcatataatcactttttagtagatttttagattaatctgttactactaaagtttatttttagaaaattcaacatgaaatcattttatggcaaacaaattaaagactgctgtcatatttgttttgattaagaggttttgtgtttctttaataaaaaattcactttttataaaagtgaataaatttatactataaaaaaattgttcccattcacatataaaaagcaaatgtcttttctaacttgcccatctagcaaataggcaagaaaatatttatagttaaaaacttgagaaatttgttttctacactgaaatagtaagaaatcacttggtctccattgtttgtgttatattacttctatgtgtcctgatagtattataaaccatctgtcatcctgttgaaaagcaatactaagcaacagcaagccattaaaatgaaatgccagacacatagaacatgctttcttgcttgtacttcctaagtgttggtcttttaattactaaaggtgggttttcttttgtgaagttttttgaaagatcatttaaccatatggcagacagttttatgtttaatagcaagaaaaggaaaaaaaattaggtctttcataactgaaaattaaaggtttacttcttgactaactttttctctcattgctggtatatattcctctaggaataaatggtttatgtagtttttcttctctggataacttcataagatagttaatatgttactgtaagaaaacttcctatcaattttcagagtatgtggacaaatatctggattccttctcttataaatcgaatatctcagaactctatttttgttacttttcacattgattaaaaatgtatgcatgcagacaatattgaaggctaccttgatttcaagagctaaaaatgttttatcaactatttcagagtaaagttctaaattataactggatatattttaggtataataactaccattttttaagtaggatgttattttgtaaaattttatcttttacctatatgtgaatgtaatgcttttgtgaatcttcttaagagtataaaggtagaaaaggtgtcaataagaagttcaattcaaaattaatttgaatacgtacatttgtgcctaatatgaaagtgaaaaaatatattcttgtgtgaacaagagcaatatgtatttatatagtggcattggtaccattgtgagcttctgattagccaggaaagttaatcagagaagttgaagtgttatacccttatgaaatatatcagagaatgagatcagtcctacccaaaatgtcactgtgcagcctaatgaggcaattgataaaatccttattaaaggagcaggagactcttacatgatagtttaaccggaatcatgggcaaattgtgaaactaaaatcatgagaactttttaacacatcataaaaattgtacacttccaagtaattaactttgcatatattttgtactcctgtaactgttgctcaaaatttaggaggacatttttttttaatgggtttagaatctatacagctgtcttctttctctcacacagtcactcagtaaataaatattgactgaatctcttcatcttggatatgttctcctgaatattctgggtatgggcatttttgctattaagagtgaattaaatttttgaaatgatccctagttatttggagaaaagtctaaaagaattagatgtttaactaaggtcgataatactttgttgggtaaaaactatgttaaagcactaaatctggttttcagatatagcttagaattgaatctaaaagcaattcccaaaaaggaatttcatatattttcttttggaatcattagaacaagaatatggtatcaaaaattttctgctttgcaaatgataatacccactagatacagataagttttgttctgtgtggtttttcagatcagcttcataagaacctaatttggtggtgtgatttaaatttcccaattcataacttgggatgtttatacaggtactgattaaacttggctctaatgtaattatttactttatttttttagacatccacagttatttcaggaaattcttctagtgccagcgtttcctcgtcagtaactagtggcttaactggatgggcagcttttgcagccaaaacttcctctgctggtccttcaacagcaaaattgagttcaacaacacaaaacaatactgggaaacctgctacttcgtcagctaaccagaaacctgtgggtttgactggtctggcaacatcatccaaaggtggaataggttccaaaataggttccaataacagcactacgcccactgtacctttaaaaccacctccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattacagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaatttctattgtttcttaccttaaaatgctaaatattatataacaaaacttggaaactttcattttaaatcaatcttcaacatttttattctaatgatttccatagtgtgtgaaaacaatgattagaatgactggttctcaatgagatcttcagaagattgaaagcatctgtgaatttaaggaaaaagaaatagttcatcttctagcaaagccccaagagttgatcctgatgaatgaggtgccttatgtggcggcagggacgacccaacatagttttctattttcctccccgtattctgggtgttcattttctgtgctagccccatttcaactgactctccctctccctcccaattatttcatctttttcaaaattattttttcattattgatttctcatatcaatggattttcctaattgatttatcatacttcatattatatctttaccttttttatcacctcatttcaattatttaagggtatatctttttccaataaattgtgaactctcctggtgcttaatacaatattttttctcacattgctcacttttcctacattgccaatgtaatacatgcacatagtacgtaataaatgttgaattttgattcatcttggttatgcacattcctgataagttttgaagaaaaataccatttcacaaaggtctttgcagatggaaatatatgacttgttcacacactgatggcttcttcctataccatgaaagaaaaggctatcttacttagtgctcaaaatgttatagcactttacctaattttagctaactttgtatacaataagctcctatataatgattaattcttgagattgttttgtacattgttaacccatttatgccagaggttgcaaatttttttggtgaaaaatcagacctgatgatgaccttgaacagtaggatataaataactctataagccgagcattgcaataatggaacactaggcataagtgggttaagtcagaaaatgtggaaggtctgcgttgttgtcttacttgcaagctaacaaattaaccagcaattgttgtacatgtatattctgagagaagataggaagccctctgcatcagagaaacagtttattattcacagcaaaaaaactggatatccaacaaattcacacattcacaagactatgaacagcctgttccatcaaacttgatttgtgctactaaatcttcactctacaaatctctaatctcaaactgtcttccttaatccctaggtttttctaacatcattattctaaagtatattgataggtgatctctgtaaacacaaagcttttaaaattaagcttggtctttttttttttaaggaaagattattattttaaactgctctgttaaataatggtgctaaattatttgtagtaaattagaatccaggattgagataatccattatctcaattatgatctcaataggcagtaaatgtctgtttaccctatatgtaaataatgaattatctcaatcctacagagacttttgctttgagaaacagatttattttgataaaacatcaatttgacataaaccccaatttccctttggggtcaaagaaaccaaaaaatacatatccataattgtttatagttcaaaaccagtttggactaaacaaaattacctgacataaaaactcagctccgcaactataacagttaatgtaacctccatacctacaaaaaatgaaagcagtaatgtttattacagttcacacattggcacttgaaatgaaaacatttatcccatcatggaaaatacgtgctacatagagttgagaagagaagcaattattttaatttctgttgtacctcagaggggactttagtttaggaggtaatttatctttcactgagtatggctctttgtatagataatgtgtgcacacgtatatttaggttatgtacatatgtataagtacacatataccgtatttagctcagtttggtattttatagaggtatatttggtattagagtttaaattgtctcaaggagcttttagaccttgatttttttcatgtcataaaatgagctacaagaccctttaactgagcagtaatgaaagtagccagttttatataaatagcatttattattttatgatcattttatttagtttgttatgtgcagatgttttccccactagaatttaagtggtatgaatggagggatcttgtttgtcttgcacagcattgtattcccactaactctcaataaatacttactggttcaatgaatgaatggacagataagcaagtgtgctaacaagtaagcttttaggattgtacattttaatcccattagtagatatgtggtgactatcatttttctattttgcatatgctttatgtaagattatataactacagattttagtgacttaaggaaaagaaaagggaaaacactaaaagaaaggccttaaagtcagaagacctggttttaaattccagtccctccatgtgaggtcctcaatttcctcctttataaaacacagatgaaaatgagatgtccttcaagtctacagtggatctgaagggagggctattattttctgtgagacgaagaagaatgtaactgacatggccatgaatccgcacaaaacagaatgcactgtgtttacatggggacattgcacagtcacaaagagaaattacactaaaaggcttcagagaggtaattataaagttttggtggcaaccaatgtggctcctcgtggtttggacattcctgtagttgacctggtgattcaaagttctcctcctcaggatattgagtcctatatccatctctctggatgcgtgggtaaagctggacagacaggggtttgtatatgtttttatcaaccaagagaaaggtcaactaagacatgtggaacaaaaaacacaaattacttttaaatgtgtaggtgttccttctacaatggatttagttaaatttaaaagcatggatgccataaggtctctggcttccatttcttatgctgctgttgatttttttccaaccatcagctcagatactgatagaagagaaaggggcgatagatgcattggctgcagctttagcccacatttctggtgtatcaagctttgaaccatgatctttaatcaactctgataaggggtttgtgaccatgactctggaaagcctagaggaaatacaggatgtcagctgtgcttggaaagaacttagaaagctgaatagtaatgcagtgtctcagattaccagagtgtgcctcctgaaaggaaatatgggtgtttgctttgatattcctccaattgagtcaaaggttacaggcaaagtggcatgattccggctggatactctcagtgccagctaaattacctgaaattaaagaatattatgatggaaacatcttttaattccagacagaggagtggctggtcaggccagtcaggtkgtcgatctggcaattggtcaggtagagagagtcgacaaagcagttgctcaggaaagtcggcaagatggtagaagacgaagtggaacagaaatagatcaagaagtgggggccacaaatggagttttgactgagtatttgatagttaatttagcagtgtgagcttgcctatttctacctaatcttacattatggatcaaaaattaggtcatcattgttgaggtatgtgtctactatttgcaaagaagttgatcgtatttttttaaaaaagtatttcacaagaatgattgtaaacaaatctacttatccagttatacctttgaataaaaaaacctccttttattgtctctttaaaaaaaaaaaaaaacaacaagaaaagaaagaaaaaagccctggctgaaggggaagtctatttagatggttggaagccttagaattttatttttggtttacactacctaggtttaagtccaggcccaccacttaatagcaatgtgatttggattaaattacttcacctttttgggccatggtttcttcataatgttttgaatattaaacaagttactacatataaagcacttagaacaatgtctggcatatagtgtgcattcagtaatgttacatgttaatatcaagttattcagttttagttcaaaacatataaacgaaacattaacaaaatatattatcaaagacttctagttggtggtatattcttcttatgtatatttggtgtatactctgatttatacatataggtgtataattcatattatccacatacgtgtataaagctacataatatatatggtttatatgtatgtatataaacatgtatgcatttgcaagagagcaatatgaaaaacaaaaacatttaaggcaaaatacatcatacagtaaaaaaaaaagtaaattgaaaaacctttggatccaacctttcttgatgataaaagaatataattactccttcaaaagatcttcacttttaaatagttgatagttgaagcttgggtcatttgctttgctatttctgttggcttagtatttctttcaacatgtatcctttataatacattcatgcaataatcctgttaggaagtacagtattcctgaaaacccagtacagtatcagtttctgtagttcagaggtttcttgctttctggtccaaagttttgtaatgtcagttttatgaggtagtcaatcaacaacttgctggaaaataaaagttgaaggcttattttcttaagcataagtcatctttccaaggtagttagctggcacgtatcctttctgcccttgagcttcagctaaccaccactctttattgccacttaggtcacaaaacctgagtatatgaactctctggtattcctgaaggctgagttcatggtcactccgtgcttgaaaagcatgaactgcatagaaaatctagacaaagaaacaaaagacattattggaattggaacctgaatattaagagaaacatcataaaagtttccaagcttttagaagcaatgctaaagtttttttgttttgccaaagtcacattgtccaactccttctattggatgtattttgctaaaatataacccaggtgagaatggagtgaaataggtattcctattattctgttaggaggaatataaattgtccatgcttgaaggcaacttggcagtttctattaaaagatttttaataatgttaaaatgttaattccttgtgaatcaaaatagcttgaagaatctcttctacagaaacatcggcagaaatttttgcataacaatgttactggattacccataagaatggcgaaaagtgggagagtagtaggaataacactataagtttagcaagagaaaaatagttaaattccagaccctcatactaaggagatttgtagtcattaaaaacggtgcaggccgggcgcggtggctcacgcctgtaatcccagcactttgggaggccgaggtgggtggatcacgaggtcagtagtacaagaccagcatgaccaacgtggtgaaaccccgtctctactaaaaaatacaaaaattagctgggcgtggtggcgtgtgcctgtaatcccagctactcaggaggctgaggcaggagaatagcttgaacccgggaggcggtggttgcagtgagccgagatcgcgccactgcactccagcctgggcgacggagtgagactctgtctccaaaaaaaaaaagaaaaaacacaaaacaacaacaaaaacgatgctttctgagactaataacatgggaaacacttatgataaaatagtaaaccttaaaaagaacataaaattagatgtacgatataagtctaatattattgtttctttgaatggtacaattatagctgattttcatttttacttccttgttcccttctttatttcccaaacctttataatgacaatgtattaaatttataatttaaaaattattttatggcctagaataatacaatatttcagtcaaaagaatttttctctgacctcaaaagaacaatttataattattaagtgcgtaagaagccccaaaataagtctttattcttccaacaaaatcataagattgataataaaaatgtttagttatggcataaaattaagcaactggcttagtttattcccattcatttatttaagcaatatttattcccattcatttatttaatgaaaatttttcaagtacctactaagtgctggttattattttattggacaacttacaactcagctaggaaaagaaaatgccagtgaacaaaacaaaacacaccaaaacagcaacaactctacacacagatgatacatcagctaatggtgagctgaattttgaaataagttatctttcataaatgacaaagctgacaaaaggcatgaatatgtcatatttgaaggtacggagatgaatacatgaaaacaacatataggaaaagacaagcagattaactctcaaacttgagattcaataggtaagggaaactatgagaaataagatgacttcattacttcattaagcagagaaagagaatgcgtagtgtggaaaggagactatagctgtagctgaagttgttatttaaatattaaactgttatttaacttttggtgaaactttgattcaattgattgggatattgatttatcaactaatatgagctgctccccaaggaaagaaccacattgctatggactgaatgtttgtttcccctcaaagtttatgtgttgaaagcctaatccacaaggtaatgctattaagaggtaaggccttggggaggtgattagccttcaacttcctgaatgggattggtttctctttaaaagaagcccaaaagagactcttcaccccttccaccatgtgagggcccaatgagaaggtgccatctatgaaccagaaagttgcccctcagcaaacaccacataaactggtgccttgatcttggacttccagcctccacaactgtgagaaataaatttctgttgtttataagccaaccagtttatggtgttttgttacagcagcccaaatgcactaagacacacatttaaacttttctccattgaccacattatggtacaaagtaggaattcaaatatttattgatttgacctgaaaattagtaggaatattcaaatatttattgaaaggcatggatatcatacaagacatcatcttgtatcataaaagatacatacaagagattgatgaacatggtcaaattattacataatttttttaagtaaagaagaaaattaaaagtactataaattctttagcaatggagtggtagcaataataaacaccttttacagagcgcatggcagttatatgttaaatgtgctttgtcctcaacaaccttatgagttatgtcttacagaagaaacatatttttaattatagagctaattggtgctgctatgaccaatatcttctaacttcaaatcctgtgcttggtccatttctcataatgctttagagaccaaactcttgttctagcaagtatgtacagagtgtattcttgcggagagggactggagtttctagtatattgtagatggtgttgttttgctgtgtagaaagtgaaaacattgaataaatccacaggaacagaatggaagatttggtttgcaaaagtattcgggaatgtaacgtactataatacatctgaaacatctgtaagagcctgcattagtggttggtaatcatcttttataatttttataaataataggtaatgctttacctatgcaactatagatttttttagcaggttagattgcctactaatagaacatttctaaatagtggtagttttttactttagcacaattctctcaagcgaaatataaactcttccatctagatctgtttggtatgaaattatagtttatattctaaatattaaaatatattctcatgaaattgtaaatttaaagtacaaaattatatactttcaatgctttagataatcatgacccaaaatttgtttaggatgagcactttttagtttttatataatttatgttaaatgggggcatatattatatactcaaaatggaagtaagctgcttttaaagagacagcagtctattttcagtctcttttttaagtctcctttttagtatttttagtctccttaatgttagactacaagttataaatttttaacctgtcatgcatttaagaactgaaagatttctcattatcttcaacattttaattgtttcagtctgtaactttctaatcttaaatgctaatatgttttggtccaggcacattaattacaatgttgttaatttgagccataatcacctaatcttcttctgtttttccttggcactttttaaaatgtattttattgattgcttctttctactctataaagctctgactcattttaggtgcagtattctgtgaatacaactcagttttctaccacacttactttttttataacactgtattattgactcatacctaatttattacccactgcttataaccactagatctttccctgtggtaacattcccagtttggcattcccttattctatatttgtgcatttgatttttccttcctccgtgagccacattacctgacttcactgaatatcattttatttttatcccaattctccaattaacagcaacaaaagtcataatatatgttaatcttctgttctaaaactaaaaggtacagaatcagcatttatggtacattatatgtatctctggaaaccaaggtagttgtattgcatgaaaaatgctcattattctctcttacccttcaggagcaagctttcatgttcttcacttaacaattatatgttttaattacacgagcaatttcgatgaagaaaaaaattttaagtaaagttaagcaaaacaaaacaaaacaaaacaaaacccacccaactgctattagtatcttcttttccttcctcccatcttcctctcttcctttcttccttctttccttccttccatttttgttttctacctacctacctgaagtggtaataaaaatggacttatagtatacataactttgcaagctgttttttacctcatactatttttgaaaatctcttcatgttaataagctgacttttttaagcactttctaaacaatgacacagtaggtatatagcatcatcatcataggtagctggaaaatgtaaagatgaagggccagactatgaacgtgggattggtagcaaaacgactactttttttagaagtcaaaaattatattttcaatattacttatgtggaaaaagaaaacaacactgattctcagacactgaactgccccccaaaactgggttttagccgttattaaacctagtcctttttgagaagtgccaaggacaagattctgcttgccaaacaaggcatcttagacactctggaaggcagaattctaggatggaccccaagaatcccaccccctattgtacatgttctatataatctcctccccttgactgtgactggaacttcttaatagatgtgctattactcctgtgattaggctacactctatagcaaaggtaaagagattctgcagaggtgcttattaaagtccctaggaaattgactcggagttagtcaaaagagggattatcctggatgggcctgacctactc

SEQ ID NO: 10780 - DNA, 12723 bp, Homo sapiens
tcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcagttctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataagagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgagatataatgacaaccttggtgaaagcaagaccacagggcctatcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcattggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccggtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagcgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgatgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaacaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccagcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggtaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttattttttttttttttaagacagaatcttgttctgtctccgagctagagtacaatggtatgatcatagctcactacaacctccaatgcctgggtttaagtgatcctgccacctcagcctcccaagtagctaggactacaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttctgcacggctggggaggcctcagaatcatggcaggaggtgaaaggcacttcttacacggcagcggcaagagaaaatgaggaagaagcgaacgtgagaacccctggtaaacccatcagatcttgtgacacttattcactatcacgaggatagcgcaggaaagaccggcccacatgattgagttacctcgccctgggtccctcccacaacatgtgggaattctgggagatataattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatataagagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccacctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggtgaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttccttagctgtcctctgcctccatctccctttctctgtaagtggaagtggtattcattgatcacacactacatgccggacaccaagctattacattttttgaatatgtttcttctttgcctcttgaggactaaccagccgggtttagattatttcctccccgtgtcgctttcctgcccccacatgttaaagatggtgcaagggaaccagagagctttgatccctggtttctctggtcacaaacctgctctcctctccagaactccaggctgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccgcatctctactaaaaataaaaaaaaaaaaaaaattagccaggcatggtggtgcatgtctgttatcccagctacttgggaggctaaggcaggagaatcacttgaacctgggaggcagcggttgcagtgagccgagatggcgccactgcactctagcctgggcggcaagcaagacaccatttcagagaaaaacaacaacaacaaaacatatggccagcagccagtgttgttatttcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaaaccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctatggggtgtctaccatctaaagttcagcactgcactgggcatttttaaattatcattagtatataattatatataataataatttaatttataactatatcatttattaaggtcctactatataccaaattctattggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcctccccaacctaaggaaactgagacccagaggttcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggacaggatgaaggaaagaagcagtgttaacattctagtaatatttgcatctgaatgatatttatatggggttattgtcctccctttgtgtatgtttaaaattttcataataagcatatttatatatatatacacataaaacatatatgtacatattatcataatgcctacctgctcttgagaaagtagtgccgtatggctgggggtttctctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttgctgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcaccacctaggtatctgcaa

SEQ ID NO: 10781 - DNA, 39320 bp, Homo sapiens
  misc_feature (1)...(39320): n = A,T,C or G, or insertion/deletion polymorphism (see Tables 1-2)
gcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtaacctaagctgaaccaattacatctgtgtagcccagtctatacaccatgtatttttctttttcctttgggattcatttctgtaggtgagtaatcctctagaccctaaactcagtgggggaccctcaccatccgtgtgcggcactgaacctgctgtcacactatgcatctaagtagaggactggttctccccatgctgggctgggaggggaaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccataggtctttcaaatgccaacaacttgtatttccaggtgaaactacacttgaaaactacactccacaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctacatgggggtgtgaagattcaatgagtaagtttagcacatagtaagtgcccaataaatattatcttactgtattcagcattaccattatcatagacggatgttaagtcttcagggacaagggaaacaacctatatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacgtattcacccattctccatcttctccttcatgcagcagaccatgtgtcaacatatgcggagtttgtgcagacgcacagaccctctggggagtatatgtttgaatttgatgaggaggagcagttctacgtgaacctggatgagaaggagatggtctggcctctaccagagtttattcacacctttgactttggtgctcagaggggtattgctggcatcgtcatggcaaggaagcacttgaacacccggatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttgggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccctcgtctgccatgttgacaagttcttcccaccagtgctgaacatcacgtggctgcgcaatggggagccagtcattgagggtattgcagagaccatcttcctgcccagcaagaaactcagattacacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttatggtcactttatccaaatttcaccatctcatggtttcgaatacccaacacctcccacatccaaggccagcccctgctctctgtaccttataactctgtcttcccttggtgccccagaggtccatgaactaatccaggtgcctgagaccatggagatgctggtctgtgccctcggcctgctggtgggcctggcgggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctccttccatcgttgaatccctggattgaaatcatattaattttatgctgcataggtttctcacaagtttcctgtgaagccaaaagggaaaataagacagataaagggtccttatttactatatactgtcttccttagcttattatgtgacagctgaaattactacgcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactcagtccagcctctctgcagactccagctgtatttacttatatctgtgccagtgacgcccaagtctgtgccttcagccccacctctcctgaaattggaggaagccggtcccccgatggaagatattatttgcaaggggagatgggcaagaggagcacagtagctttcgggaattgaccagggacaggtgcccagggacacacaaggcccagaagatgcttgtaagaagccagggagactgaaggcatcaactggatgtataagagagctgctgtgcactgattgtgtgtatcaggagtgaagaatccatcctctacacgaaaaagaaagcttacaacaaacatgtcctctaccttgaccaaaaggtgtcaatatgagacgcaaaacacataacaatgttggattgttaagaaaaaaaaaaagaccagtgtttgaaaaagagtgctacatgtattgctttgctctttccccagtggggagtcatttctgtctgtatgaaaattaagacaggaggcctaggctggtggatgaatgcagacttagacgacaaatgacgtctattggatgcattcaaaagtccaagccgtatttggttaaggagtatttgtgatggcacacaaagaaaatggttaaagtgtattagattatatttatgattttaaattctgatgttcatttaacttcttaatggtaatgataaaacatgctctcagtaaggtatatgttgaattagtgctgtgggaatatgggtcctatcaggcagatttgcagtctgctcaccattgaatagttaagaatagtggtctgagacataaatggatgagggcactaaacttgatttgggggcagctcactgaaatacagtcaattcagaagagtgtcatgtgtaacaggccccattatacaatagttaacatatccccattttcatggttctcttctttcctatgtttaaaccaaaatgaacttctttattaactcctactgtctactaaaaccctcagagaaaagtgatgagagatgatttggtgcatatttttaaaggaaaacaaacagtcatgttgggttttgattatttgtggtgctaagaagaagggaacatggttggaggcccagtgagagaaacagtgctttgaatcaaagagcagaatgatagaaactgacttcagagcaacttcttggcagcagtatccaatttggaagttgaaggtctgtcctggagccagatgctaacgaaacacagcaaatgcttttcctaaggcacaatagtcttttcagtgagctcaggaaccctgtgggggtaaaagacaagttatcccaggttgccagcctccttcctgtaagtccaggagagaaaaattatggtgagaggatgcgtctcaggctgataaataacagagttgatctctgcttccttcagcaatggagccaagcaatgctctttccccacttgcctgaaggctgacattgaaagaggggttcatgcctgagattcccttcctggaggagcctcagtgttacaatgcacagaaaggactcatatcctcctgcaacccaccccacaaggaaatcaaagcaggaatattacctgtttatgcagatcctcgttgaactgaaatgaaagacgaaaggttatataatcagccattgaaaccacctcagataattagagaaacatttccatcccaccaaattccattgcccatcactcaatggacgctccgcaggagcctgagtacttgggacctcatgcatctggctgcattaagatcccagcctgggatccchctctcgcyataggtcatgtttgttccccgaytatctgatwtcagtggcctctagagctttctgacatttcttttctgtcwracccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggaggttggttcttatttatttcatgttacagagcaggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttcrgcccgcagagtgatgttcagaacttccaatgctatgttaaacatttccagcaacgaaggacatcctatcttttgcacaatctcaaaggcaatccacctcatttctttgaaatatatatgctatagatttttggttcactacctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgtttttataatgtactgttggattcagtgacatggctaaaattagtccacaatcctgttctcctgtactattcttagctggctctggaaatataaatgaaccaacctcataaaatgatctcaaaaattctgttccattctatgttctagaatcacacgtgtaagaggcatgatctgctcctggaaatgtgggaggacgccctcatctgcaataagatcaggacagggccctttggaaggcgattctttgcttcccatgacaatttctttgatattctctactctattttagttttctatttcttcctgtagttttgacctttatatctttctagaaacgtatccgttttatctaaattttcaaatttatatgtatagagttggtcgtaagattttgcattttaaaatgtgtataaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttrtctcatttattatgtttcttattccaatctttatcaaagctcaatatttgtgcttgattcagtggcttcttgcttttgcttcaaattcccaaattctcctttacttctctatttaagccctttctattgtgaactaggggacatttggaagaaacacacaaaccaatagaatgtacgttgaatggttatcaccgcaagcacccatgtaactagtacccgggtgaagaaatagactgttgccagcatccctgtgcccctccttaggccaggaggtagtgtgtaagcttttcaggagccaaaggctgctgatatccataatgcctagcattgctcctggtacacagtaggtcctccataaatatctcttgtagaagtattttattatttatttagtgtgtacttcttaaatgttttccaccttcaagtattcccacttatttgaagttagttgcagccatatgatttacattggaaaatgaaatgcgagaagtgtgttctttctaggagggatcattaaaagccagtgaataaattcttaggttcccttcattctgctggggaggttctgggagcagatgtgcaggagaaagactgtcagcctggcttcctgagtacgatgataagcagagcttcctggatgacttactttggacgtgtagcatgagccaaacctggatatctgggtatttgttagtttagcacagctgatcctattcttactgtgtaaaagaaattgaagagaaggtgctcaatgagacttcagagaagctgagagacaagagaactaggaggatgtttcatcccataagccaagtgcacaggaatttcagggacagtttacaatgcaacatgctcaaaaggcatcaactatggtaagtgttcactggcctggtagcaagtggttattaaaacccctttaaagagcatcttcacacccaatgcccaactcccacctccttccactttcaccatcccctggctcggcctcactgctacttgacaaatggggacaaagagagggtgagatgatttcttcttagggtaccccttgataaccatctgaggcagcgttgtctgttgggtggaccaccttctcgttagggaactgtgaggggtagaaaatgaagggaccaggtggaaagggatggaggatacaacactcagctgggagtcctaagcccgccgggttttttcttctgcaggtatcaatttttctgagtcagaggttgagtcacccacttcacatctcctttaaagctccagttccaactttcctttgaatctctgctcttcaactccaatgactgatgtacctcaagactcctctacctcctggctgcctttgatcctgctgcacatagcactcagcaaagggcctgactcttagaaaacactctatcaatattgaaaatttgaagtctagtgacaaggtggtcccagtttggatggtctctcagctcttgtctcctctgggacctgtctctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctcaccctgcaggcttttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaaccccyaagccaaggtcaggaagtctccattkccctggcttcaaactatgctcaggagctggtatagaagaaagatggggtttggacatggccccagggtatagatgcagaagataagatgagtggaccccagagccagagagtcccctgctcttcagaggtggggtctagabggtcatcagagactcactccactccacggtgacaggactrtccakgctggtgtgctccacttggcagrtgtagacrtctccctgctggggggtcatttccagcatcwccaggatctggaaggtccagtctccattacggatcaggttggtggacacgaccccagctgtttcctcctgtccattcaggaascatcggacttgaatgctgyctgggtagaaatcygtcacgtggyagacaagcaggttgtggtgctgcargggcyccttcttggagggggaaacrttcaccytaggctggactaggagcgtggaagaaaaataatgaaatagaatttgagattgtccttctttccttccttccttccttccttccttccttccttccttccttccttccttttttttgagacataatctcgctctttctttctttcattctttctttttgttgagatggagtgtcactctgttgccaagtctggaatgcagtggcgcaatattggctcactgcaacctccacctccgggcttcaaccaattctccttcctcagcctcccgaatagctgggattataggtgcctgccacttcacctggctaatttttgtattattagtagagacaaggtttctccatgttggtcagcctggttctctaggagcacttgaccaacgcctgacctcaagtgatccacccgctcggcctctcaaagggctgggattacgggcctgagccactgcatctgcccagattattatttcttaggcatgttcactatgtaattgattcctagatgttgaaaataggaataatgtgattaggctagtgggtaagggtagcattgaaaagatagaaatagaccttcaagtagagcatgcatgatcttgaataaaataatagttagtaagtatatagcggaatggcagggagacagagtttgcactctgtagcacatttaggagaaattttaaccaaaagtaatttgggcaaagaatatttgatcaactgtgaaattacctaccttttcaaagttctatcttgatacaaaggaagcaaaatttactcaaataatatcttgaaattaagatatacagacaatggcattatggtggcctgtgaatctaataacttcatgaaaatacaaagaaaatgaagagagctttacatgtcttattctgtaaaaaacctatgtatttttttacctcacctacaaaaactcaaaatcttcatatttacagaatatcctgagctcctacatgcttgagtagtagaaatcccgtcctttttcaagttcctcctctgtgctgcgtcttcaggtcccatgaaggtctcacagatgaccaggtgttgcctccctctgcatctttgcatttgtgccccagcttgtcctgttgttctcaggtgaatttccacactgccactggcaacttttcttttggatctctgccaccagtacctttttcctcctcagaaagcagaaaaggccaggcatggtggtcatgcctataatcttagcactttgggaggttgaggcatgaggatcacttgagcccagggttttgagaccggcctgggcaacatagtgagaacccatctctaaaaagaaaaataaattagccagacatggtggtacgtgtatctgtagttctagctacatgggaggctgaggcaggaggatcacttgagcccaggaggttgaggctgcagtgagccatgatggtgccacagcactccagcctgggagacaaagtgagaacctgtctcaaaaacaaacacaaacacaaaacaaaaaacaaacacagaaaagggtcaagtgctcctagagaacagttcattcagggagatccactagagaacagctctttcagaggactaccctagagaacagctcatcaagaggaatgtctcaaattagtcttctaggtccctaatcactcagttctttcctttctacttcctggagaacacaaataccctaacatggcgctgggccaggtaaaagtacagtcttgaactgacacacaacccttactccctattgtatttttgccttgttttcagactgatccacattgtcagcctcttccctcaatgtgagtttatttcaggggcacctgtgtctcactacttcattacctcggttaactcaatgtccattacactattcaacttatgtctaaatctcagttgtgaattacctacaatttcttccccatagagcttctgggaaccatgaaatcagggggaatacttgggtatctgttttaaggtcccagaacattccacgagaggcatcttgctcaatattctttgacaggagcaggtcagcctggagccacatcagtgacctccagggtgcgctggagttaaggcctgatacccaatggcctcatttctgacccagttcaaatacatttcaccaaggcaaggattcctgtttgttctagttgccttctctaatgcccagaaaacatttgctcaattacttctagatttgggtggacatccaccctggaattgtcactacttctttcctcccccttccacctctcccttgcctctgtgttttccctgttctaactcatgccttgattgcaatttccctgacaaataatagcagtttcctacctcatctccctgcctctggtccctcctctagccagcacccttagtagtcttctgaagacacatctccaaccttctctttttcatttttcaaaaatcttcagtgttctgacaatacttatctggctacatgggaacctctagggagctgattacaagcagagatccccagacctccccacccagggaatctgagtctgggggcactgagtctggagatctgtgcatcacagaggatctccagaagagtcttcagaggagtgaggttggggacctgcgggcctggaggagaaacccacactccttaggctggcatcagggctgtctgcaatctggcagttgattactgtgaaagaaaatgctgccatgtcactgattggtgcctctacaaagtcttagtaacagtttttgccaattgcgttatttttatttgaacacctctctcaaccaattacctcagcaactttcctaagctcatgtcactcacctcatccccacccagtgtgtccaccttctcactcatagcaggtgaacttcctttcactttccaggaacaagaaaatcaaaggtgtgatctccccagcttcctcctcctcctcccttcatttttttcctctttctagaaaaaaggtccagggctcaatcccacatcctgatactactccctcaagtccctcaggttggtgcaccaggctccccaccccacaagttcacaggaggaagccaaagctccaaggccttcctgtcccatccttgagaaatcctcttactgcacacacctcacctctctccatccctttacacccagacttcctgaaggaaaaagacgaatgaactgagacactgccctgtgacagccgtggggaacccaagacaagtaaaatccatctcagccccgaggaggatgcgccacactcagcctcatgcaccccctcccattccagctcctgccgctgcggccaacctgctctccccaggtctccctggtttccaaacccactttccatcttctgttttctgaccttcccaagtcactggcaccgctgtccactgtgctgctgaggtcacctcccctcagcttccaagactcttctctgcgggcctctcctcacactgcacttgggtttttttggtctctttcacaggcttttctgtcttggccaaatcacaactgtccagttcccaggatccrgtcctttgctcttccccctgggtcccctctccctggatggtctcatgtatctcagtctcctccccggctgcagacccttctgtctacctgcccatcagaccacccatctgcccctcaagcacctcaaacccagctacctccctgtaggtttcttctctgtgtggcctgctgtgccatctccacctccatctccacaccatacccttgtgcgctgtcctgtggcttccttttttcaccccacatgcagtcagctgccaggcctgatgaagtcccgggggtctctctgctctcgtcctcctcactccatgctcagcccagtccaggtccccgcgctcgctcccctgacaagctccagatgggctccccccatgaatccccaacccaaagtcccctttccgcccggcactaaggtcccttaggccaacccggctgctcctgcgccctgggcacgggcccrcggggctgccctgggaccsccggcccaaagccctcactcacctcggcgctgcagggtcaysgscycghccagctcgtagttgtgtctgcayaycctgtccggcactgcccgcyyctcctccaggakgtccttctggctgttccagtastcckcakcaggccgccccagctccgtcaccgcccggaactcycccacgtcgctgtcgaagcgcrcgwrctcctsccggttgtagatgtatctctccaggaagcgctgtgtcccattaaacgcgtagcattcctgccgtmmctggwamasgtaattctctgcggggagggggcggacatgagcggaggcgccactctcatctaatcctctttctccctctctctctyaatattaasgattcttcccaaatctwcccacycagggctrgattttaaaataggagttttcctagtaycgagttctgtggtcctaagcgggtcgcagagcctctccaggcctgttttctcaccacgcagagagagaatttactgaaaagaatgagctcaggggcactgagtgatcactagggaggggcgagcactgaggggaaggcagtcccttctgctggtggctggaggaggcggagacgtttcacgtggggtcactgggagaaaaaacaggggcgggaggagctggggacgtggagggcggagctgctccccctacttaactccctgactgacatttccatcctgatgtcagtcctggttcaaatgccacctcctccaggaagccctcccttccttctttctcttttccatagctaagcgctctctcttctcgaccagtttcttgagaattcctcaacttgctcctgttgttttgcatgtaggagatgtagaaatatatttcttaaaactttcttcaactttggtataagaaagactctgtagcctgaaagttaattttcaaacatggctgcagaaagacttggtgtcaaaagatgtggaaagtattttacacaatgaaaatcaccacaacaaccagggacctgtgggggtagagtcctttgggtttagaggcattgatgtaattttttttggcagtttttatggttttatttacacacaaaacgtggacatgaactttctactcattttcttagctgtgcaccctggtactggggttggtgactctgatggccggctgggtgactctttccatgatgactttgcagttctggaggaaattttgtgagcgatctcagcacagtaagatttgttgcacatcagcagcactttcagctccttgaggctgtggaccagaaacttctggaagccactgggcagcatgttttttttgttgttgttgttgctcccataagcaatgttgggcatcaagatctggcccttggaccttctacgaaccctactgttaagacctctgggtttccgccagttatgcttaattttgacatttcagtctgattggtgcctcatgaacttgttggtcctctttttgaggatcttatccttcatgaggagtctgagggaggccatgatgtggaggaagagatggctgccagctgcataggcagcaccgaggaagacagcattgatgtaatttttacatgaacaattttggcagcctttcccacatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgctaaggcaagatcccaggtcttgactcagatatcctgacctgcctcttctcctggtgccttgggccccagaccctaaaattccaggcccagrgccccccagctccttgagtccagattcctcctcctctgccatccatccgcccctgcctgttcaattgccccactctgagtgtggattctcccattttcatttgttagtctttgtttctcctcctcaatcaccagtaagagaacgtttttcattcaagaataagaattttgaattttttctttgcaacatttaatttttttaatttacccagtcttaggtaattttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattcagaataggatatattaaaaacctctagctccctatgggttgtctcagccaagcttttctcccccagcctctttaagctatagcctggctcctcagccctttggtcttgtgccctgtttgaggttggggatgtgtgtggagttgggggagcatgcagggaattgtggaatcagccctgcccactttacccactcccctatggctccagctctccctccagcaggttttgattgaacattcattctacgcagggagctccagtaatctaccctcagtccctgtcacatggctccactgcctcatctcattccccctacaaacctcaacccagcctttgccygtcctccctttcactgcccagcatcacatgcccccttctgctctctgctcccccacctctgggtttccttggtggctcccaacactgtccctcatcccacatgacagctctgcctatgggatggggrygcygcatccgtcacytcctcctgacactgttcagtgtcaccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaaagtggaagtcagtggaaaactaaggtacctactttgcagtccttcctctcagagtgttggtgtaaatttggactagaaatgtcctgagagtacaatggttgaactagtttacagtcccaccaacagagtaaaagtgttcctatttctccacatcctctccagcacctgttgtttcctgactttttaatgatcgccattttaactggtgtgagatggtatctcaagacagtgtggcaattcctcaargatctagaactagaaataccatttgacccagccatcccattactggrtatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactgtgcagccataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaaggggaacatcatacaccggggcctgttgtggggtggggggaggggggagggatagcattaggaaatatacctaatgtaaatgacgagttaatgggtgcagcacaccaacatggcacatgtatacatatgtaacaaacctgcacgttgtgcacatgtaccctagaacttaaagtatatatatatataaaaagaaatatcctgagagtatcctgagagaaaaacaatggatcatagatgccataatattacaccagccacagggaggcagcaggaagaagagatttttcacttggttactgcttccttggctgtctgataacctacactcaatccctgtcatgcacccacacaacctcatctcattcttcctacaagtcgcaacccactctagtaccctaaccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctctgcctgagtcccctccaggctggatgcagayrtgaacacgcccaggagcctgcacttgccaacttctctctstgcaaaccttgtctgtccaaggttatccwggacctcttggtcccattttccccaaagacaagcactgaccactgggcacctctctctgtttactgtacccatgtccttggagagagaataggccagtagggtagcaagctatcctataggggatgaacctctttctctagctgggaagagaggacactgccttagggcaggagcccccgcagcctgtctcagaatttgatcccttaaagataacgtcccctaggaattgttccctgagccagaccctccaagaatggcagytcggctcttacctggagtggccctgccctggaccacagatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattggacagagtctgagaaaagaaccaatggacactgagctttgtatgagtcattgctcactaggcagaaagttagtatgaaaggtctgaaaatataaagcctgtgatgcacttaagatgacggaggaaagacagtgatactcattttaaccagtcagataagtcatgatrtttggsgagattatgcgttttctttgctctgaaggtgatctcaaatattctgctggcccatctacagggattatcatttccccaattctgccacacctcacacacccacaggacatggtctgttgtggaaaaagtgctatcttagtgtgtaaaaggtcattcagtggcatgacttagagggattagagtacccatctcagaactcaaatgaggtctgagtctgtctgtcttgcctttgtccaagggtgtgtttaagattagcacccattcatatttactttctcccagaggtctgtgagtcctgcgatgtgcaggagttaccaggttcttccacaggactgtcatcagggtcaggagggctcagtctagggaccttacactgggagcgtggacacaccacctaccctaccatgtaaatatgcagctttaacgacactgcctctcttggacttcgattccttgtcttcaatatggggatgatataacctgccttatagcaaagctcttaagatcaaatgagatcaataggtctgaaattgctttggaaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttcaaaaaaaatcaaattggcatcatttctttaaatcaatattaaaatgtaaatagaaggctagcatgtaaaatgcaagagaagaaaataattatgtagtagaaggtgtctagtaggattaaggggccaggagaggattgtggagaaaaactcagtttttttagtaactgcctgggtgggacttttctccttgtcatttacctgccatagataattagacaaatacttcctcgatgtctcaggtaatttatttttacagtagacattaataatacctccctcaggtttaatatgaggtttaaatgaggtaatgcatgcaaagcactaataacagaatctctcatgtcctaatctgttagtaattattatttatgcaaggtaaggctaccacaaataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagagaaacccttcttaaaaacaagatcaaaatatgggcgcacattgttaccacaggtaatgctgtcctgggtattcttatatgaaaatgaaataacaagactagtaatttaaagataaaaatgttattacactgtttaaataccaggaaaaatcaaatactaagaaatctgaaaaataaaaattatctagaaatttcactaacaaaggtaaccaggaatagataaacaattaaagatcaacttcattcaagttaattaaaacctctaaatagaaattataacacttctgcagaaatgattaaataaaaaggaggtatctcagggaggtggacctgaaagaaagattaattatatattttattagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtracttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctyatcrctgytcctgtgctcacagtcatcaattatagacccyacarcatgcgcccwgaagacagaatgttccatatcagagctgtgatcttgagagccctctccttggctttcctgctgagtctccgaggagctggggccatcaagggtgagtgstcaggaggacgcargagcgtyggggtgagtgatggggtggttcacatcaattgytgcttcaggratcasagattttaggggctcattgatctatctggtcctcatagtctatgttccctctggccctcataataataacagcaataayagccagaatttatgagackcctgcataktttctttccccatttacatctcacaggaaycttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcrtacactgccttccccagattcctgcacacagtgacctactaycagggccctcctatctctctgggatccccagcctctatcttttgtggctgctttacaggaactccgagctatggactctgcattaggagacgaagtgcaaagagtgtttctgtatcctccctctcttctaggaccctagggctcttcctgggtctttgtgggtggtcacaagctttcctctctcaagacagcagggttgcatggtcttgatagccttgtgattcgggttctgagagattcaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttctaatgttatgttataataaacaccacaataggcttctcttcatagatgcaaatactttttagtattcttggtagaaattcctaatgagctcagctgtctcttcagggcttccctgcccagtctcttaacatttaaacatgtcatttaccttaaaaacataagtgcaaaccaactgataaaaaacaaccttgccttcagtctgcatcctgtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcggcaattctgatttttggcactcttcctggaaaatcttatttaacctgcacctgccactaatgactctcagttctatggcctaaattcctctcctgagaccacccataatccacaaatatctatgtattatttctccttagatgactttcaggtcttctaagtgcaatagccccacagtaaactcagtatcttctcccggtcaggctgtcttccctgagagaagtggcttttgccctgttttctgaatgcctacattgaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcgttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagtttagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacagtttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgagtgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgaccycttacyttcttcctttttatattcataagtctttattcattctctagctttsaccacttgcatattcraaytgacattttgtcrtgtttttctctactktctttatgcagcggaccatgtgtcaacttatgccrygtttgtacagacscatagamcaacaggrgagtttakgtttgartttgatgawgatgagmwgttctatgtggatctggayaaraaggagaccgtctggcatctggaggagtttggccragccttttcctttgaggctcagggcgggctggctaacattgctatatygaacaacaacttgaataccttgatccagcgttccaaccacactcaggccrccaayggtackscctatctttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatacccctctctgtgattcagagctgccataaaatctaaggctgaggtagaggaccaccctcccctaagaggtggagcctttgtgattcatcccagaagaggggcctaacctggtgctgtctccttccagatccccctgaggtgaccgtgtttcccaaggagcctgtggagctgggccagcccaacaccctcatctgccacattgacargttcttcccaccagtgctcaaygtcacrtggctgtgcaaygggragcyrgtcactgagggtgtcgctgagagcytcttcctgcccagaacagattacagcttccacaagttccattacctgacctttgtrccctcagcagaggacktctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcgtcctaacatccaattaactggtccataaccttcaattcccacaaccatcccaggccatcaccaccctcactgcacctcctgaccctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaayaccgataactaactgagtagttaatatggtcaggcgctattctgaggatttacatttattaactcactttattctcacamatagtctttgaggtaggtactattattttcacyatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagycagatctatatttctatacataattacaacacagtgtggtgggwgcctgtaactacttactgtctctacttggactcattccatggcaatgytcacacaaaaaatgcccctccagagatcttacaggtttctatytatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatsctcystaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcatggtggaaggcaagtggagccagtgcatcacatggtcatagagggagaaagagacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggctataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactgtctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacatttactactttaattcatctgggattcatctttgtgtttgatggggatcatgttttatttttctttatataatgggccagtgtgttcccacaactactaaatagttcaccttttccccataggttagtagtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatytgaactccagctgccctacaaactccatcwcagcttttcttctcacttcatgtgaaaactacyccagtggctgactgaattgctgacccttcaagctctgtccttatccrttaccthaaagcagtcattccttagtaaagtttccaacaaatagaaattaatgacactttgrtagcactratayggagattatcctttcattgagccttttatcctctgktctyctttgaararcccctcactgtcaccttccygagaatacyctaagaccaataaatacttcagtatttcagagcrgggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaattcattgcaatttttaccagccatagtcactccatgtgggagaacttaaatcatgattaccagagctttcaaaggtttgagaatagtgatgattatgaagaaaaatatcttatttgagcaaggattttgtttctttatgagtgttcattagatattacgatgaaaaaagcatgaaatggtaaaaattcagataaatataaaaacatgttctctagttttttttaagttaaaaaaggaattgtttaaagtaaaaattatttgggggtttataacatacccagaagtaaaatatgatgacaatggcacaaagaatagaagggagaaatggaagtataatgttgtaagtttcttatacatgttaagtggtgtgttattatttgaaggtagaatgtattaagatgaatattttaagctcctgataactattgaaaaaaaaagaggtatagccaagaggccaatggagaagataaaatagaacactaagcataattaattcaaaataaagaaataaaaaagggaaagtctggtaagacaaaaagaaaacaaactgtaagatggtagagtttaaaacaaccatactaataattgaattaaatgcacatggcctaaatattctaatgaaaagggaaagattgtcagaatgcacaaaaaaatctacaggccaacttcatgctctctacataatgccctctttaaatatgaaggcaaagacaggtaaaaagtaaaagaatgggaaaatacatgtataccgtggaatgctatgcagccataaaaaaatgagttcatgttgtttgtggggacatggatgaagctggaagccatccttcacagcaaactaacacaggaacagaaaaccaaacaccacacgttctcactcgtaagtgggagttcaacaattagaacacatggacacagggaggggaacacctcacaccagggtctgtcagggcatggggagcaaggggagggagagcattaggacacataccgaatgtatgcatggcttaaaacctagatgatgggttgatagatgcagcaaaccacatggcacatgtataactatgtaacaaacctgcacattctgcacatgtatcccagaacttaaagtaaaaaaaaaaaaaacgaaaataatgccaaccatggaagtattggtggctgtgttaatatcagaaatataagactcagaaatattaccaaggagaaagaaggatagttcataatgataaaaggatcattttattatcaacatataacaatcctaaatgtgtttgttcttagaaaatatgtcttaaatcacattataccaaaaatgataaaaataaatcagaaatagacaaattcacaattatattttagtattctagcactcagtaaacaataaaatatttaggaaaaaacttcatgaggacatgatagatttaaataacattatcaatgaaccaacgtgatctaatcaagatctgtagaatattccacccaatagtggcagaatacacattattttcaaatgctcaagaatattccacaggacagactatacactgggtcataaacacatataaataaatgtctaaataaataaatgtctctattgaaatcatacagaatacattctcggaccacaatagcattaaattagaaaccaataacagaaaaataccttgaaagtcccaaatacctagaaattaaaaagtatactgctaaacagcacctggatttaaaaagagtcagaaggaaaattagaaaatattttgaactgagtgaatatgaaagcacactatcaaaattagtatgatacactaattagagaataatttataactttacataattggaaaggagggaaactctaaaatcaaccatctatgttcccatcttaagaagctagaaaaaaaaagtcaaatgaatcccaagattaataagatcagaaataaatgcaataaaatggacaaacaataaagaaaataaacaaagtcaattgctggttttcaataaggctcaatacattcatgaatctctaggtagatggatcaagaaaaagagataagactcaaatccccaatatcagaaatggaagtgggtacgtcacaacaaatcatacagacattaaaagtattatgacagaatgctatgaaaatgccaataaacaaaaatgacaataaatttgacaatttacattgttaaattaaattaaatttggtgtaaagctttctccatatcttaaattcctacatagcaaactaacccaacttaacataactgcgttatgcaaacaaactacagcctaacttaagagtgttgtaataaatagctgagtctcagccaatcacaggctgccaagtgatcatattatgtcccccataaggcaaatgcctcatcacgccatgcccatataaggcaaacactgagctgtaataaattggctggttttgagtatcacttcctgtttttatctataaacactgccttcacatgttgctggacagagctttctgaatctttctgggttctgagggctccccaattcatgaattgttctttgctaaataaactctgttaaattcaacttctctaaaatttttattttaacaacatgaaatagaaacatttcttgaacgattcaaattaccaaaactaaatcaagaagaaatctctgtcaatggaagaaattaagtttgtaattttaaaaatccttctcacagagaaggccaaatggtttccaggtcagatggcttcattgattaatccatagtattctgtcataatactgtcataatacttttaatgtctgtatgattaattctattatacatttaaggaagaaacaatacaaactcaatacaaactctttcaacaaaagagcagaagaaaacacatcccaataatttacaagtccaatatactaacatcaaacaatgacattaaaagaaaaggaaactaaagacacacaaacatagccatgaaaatgtttaacaaaatattttttaaaattgaattcaataatatattaaaaaggatgatataacatgatcataaaagtttatgccaggaatggaaggcatgtttaacatgcaaaaaatcaatgtgattccacatcttaacagaatacaaaagaaaaattatgtaattatgtaaatggatgcagaaaaaggcatttgctcattcatgataaaaagtcctagaaaactaggaataaaaaggaattacctgataaggtgtgtccatgaaaaccaacaactgaaattttcaattttgggtgggggaggggggcgggcattttactttctccataaaactattaaattatctaatgtgaaagtggaattcagtgaagaaatgttccctactgcaaaaatacaaaatgctggacattctgtgaacagtttctatgcattctatataaatgaaactattaactatataatacatttattgaaaaaagaagatggccttctttttttttcctaatggctgttgaatttatttgcttgatcaataatggtcctggcaaaaattgaccaatgctgagacatttgtaatgaaatactaattttaaaagtccatgacaccttgatagaaattagagtttacacaaacaaaaaaggaaccttcgatatttccagcagctacaaggtgaatgtactgagaccgacaggacagcaagaaggcatttgcacatttatatctgacaccagaccacactttcagccaccagaatatcttctctccatattttaaaaaatagtgtctctccctctccctctccccacggtctccctctccctctccctctccctctccccacggtctccctctccctctctttccacagtctccctctgatgccgagccgaagctggacgatactgctgccatcacggctcactgcaacctccctgcctgattctcctgcctcagcttgccgagtgcctgcgattgcaggcgcgcgccgccacacctgactggttttcgtatttttttggtggagatggggattcgctgtattggctgggctggtctccagctcctaaccgagagtgatccgccagcctcggcctcccgaggtgccgggattgcagacagagtctcgttcactcagtgctcaatggtgcccaggctggagtgcagtggcgtgatctcggctcgctacaacctccacctcccagcagcctgccttggcctcccaaagtgccgagactgcagcctctgcccggccgccaccccgtctgggaagtgaagagcgtctccgcctggccgcccatcgtctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcctggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaggaacccctccgcccagcagccaccctgtctgggaattgaggagcgtctccgcccggcagtcacctcctccgggagggaggtggggggggtcagccccccgcccggccagccgccccgtccggcaggtgaggggcgcctctgcccggcccgcccctactgggaagtgaggagcccctctgcccggccagccgccccatccgggagggaggtgggggagtcagtcccccgcccggccagccgccccatccgggagggaggtgggggggtcagccccccgcccggccagccaccccatccgggaagtgaggggcgcctctgcccggccgcccctactgggaagtgaagagcccctctgcccagccagccgccccgtccgggagggaggtggggggtcagccccctgccccgccagccgccccgtccgggagggaggtgggggggtcagccccccgcccggccagccaccccatccgggaagtgaggggcgcctctgcccggccgcgcctactgggaagtgaggagcccctctgccccgccaccaccccgtctgggaggtgtacccaacagctcattgagaacgggccgtgatgacaatggcggttttgtagaatagaaacgggggaaaggtggggaaaagattgagaaatcggatggttgccgtgtctgtgtagaaagaggtagacatgggagacttttcattttgttctgtactaagaaaaattcttctgccttgggatcctgttgatcggtgaccttacccccaaccctgtgctctctgaaacatgtgctgtatccactcagggttgaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtga

SEQ ID NO: 10782 - DNA, 15312 bp, Homo sapiens
gagaagaaccattcaggtcccaacggtctggctggtcattagttctgtggtgaagcttgaaaagcaaatcagcaacaatagtaataacaataacacttttatggcgcgttgtgctcatttgtacgcatgtgttataacgatcgcgggacgcagcacctggcagtagaaacagctgctggacagcggcaaggagcgcgccgcccttgcaggggaaggggctgggtcagccgaataagccgtggaaatgggaacctgggggacaggaaagcagggccagatagcttgccaatagcccaactgaaagaaaaggttttacttcccttttaagagacttctgcccttccctgaaactctgcacagctttggaaagcccaattcctaatccaccctgttcggttcccctgcccctccttggaaacgaggctcggtcctccctacgcgctactctccggcggttgggccccaggcaggaagtttctgattggcggagtcgtagaagcaccgggtgaaaagagctccactggctgcgcaccggagtccgggcgtagccagtgccgtacggcaaaatggcggcccccagctgctttgggacgcctgggttcggggagacaaactccgacctggaagagaccgctgactatgtgggccgcactggaggtgttcgcggggcgggcctactgtcacctccggccacaggaagcctgtgttccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggtgggggccggacggtgcggggatcagaggcgggggcggggatatagagggagaggtattggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcggtgcggggggacttttgatcagttacgggtcaccgagagaatggggaaaattagggtggggtgaaagggaggggacttgggtaaaatatcttcaacctaaagccccagtttgaggagactcatcggagggtgaaatatggagataattcaaggaggagaaaagagaacggactgttgggagggaacctctttcacctcagagagtctaggagttggggtgatcattcaggatagggtgggtgtggggttgacttgtttgagagcagagggggcaaacacatgaggtggcgcccacaggagtgtgttgtctgtgcaagggggtgtcaggacgatttggggtgcagtgtgggaggaagaatcaacttgccaactctaagaaataggggggaaatgcaacagaaagaccggaaatcgacgtgaggggtggagcagaaggtggcaacttaaggtgtgggggtggtttgccccccccccacaccacttgaagggccccaaaaagcatatagaactaatggttattgaaatcaggtggtgaagacagtgttggtcagggctggatgttactgaaacccaaggagttcagaaaatgtgtgaggtgaagggatggggctatgctggaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagaggtgagctttagcggggaagattgttgtaccccagggagggggatggctgactggttctcctgtcctttctttcccactaaccccacctcccctttctctcaaccccctcccttgtctctcttccccttccttcttcccctgaaccttctagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggtagggggttggtgggatgcctctcagtgacccttatatgtcaggtatgaggcggatggggcatctctctagtcctttctagggtttttactcttctagtcccttcaagggctgagtgctctgactttatgtcttcccacgtaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgaggtgtggatggggtacagccttcagagagacattgtccttcccctgcactggccaccagggagtccaggttgactgatgggggagcatgagaaggaaagcaagaaccaaaccctctggggcaagggattccttagagaaacttctttgtctcccagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtatgtcaagggaacattctcctcacctgtcatttctgttttgttaggcatgagccacctgtttgaaacctttcccttcctcctcctagtgtcctctcagcagtattttttccccctcattctcaggctaccctctccccttttcttcttttccaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacaggtaataacaagaggaggaggaagagggaagccaaggagggattgcaggggactttcggagagcaatactggggaactgagtctgctgggagagactggactgcccccctccagcctcagtcttcccgtacccctccacatatttatgtttctgtttctagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatcactgtctttttcttgtccttctactgttacagattggcattagctgtccccttgctcagggttagcccagtatccccggggtagtcccgctctgtcctttctagcctggcctttttttttttttttttttttttgtctcgctgtgtcgcccaggccagggtgcagtggtgagatcacagctcactgcagcctggacctcccagtctcaagcgataatgcctcagcctcccgagtagccgggactacaggcgcgtgccaccatgcctggctaatttttgtttttgttgtttgtattttttgtagagacggggtttcgccacgttgttcaggcagtacttttttttttttttaagtgcttcagccgccttaacgcactttactttttcacttcgtgcagtaggagtgagaaagccaatgaggggccgactcaaggttatttagccaatccaggcccggagaaagggggcggggcttcagtgggactgtaaggagctaggaagagggcgattagatcccaccaaccagctaatggtcacagctcagaggcggagcctggggaacgatacctggacccatcgccaatgggaaaaggcaggcttatagctttaaaggggaataaatgcttcggccgaaccaagtcctgagctcccagcggaggaggggacctgatcttttaaggtggaatgtggcgatgtttctttaaaggcaaagtggccgagtcggccgagtattgcccagcggcacgggcggggtgcccggctgtgcctttaaaggcggaggggcgggaggcggagcggaggcggagggcggagggagtcggcgcaagatggcggcgggaggggcccaggttgctgctctggccgccgagtgaggggcggggggggcccgggggcgcgcggcccggtaagcggggacgcgcgaggttggggggcgccttccgggtgggagaagaggccgaggtagcgcttggggcggagcgggggggggcggggtccgttgtgggcggaggtagacaaggggcggggtcgaaaggcccgatagtgggcggggcacggggggggtgggcctggaaaggggcggggctagagaagctggggcgaaagggggcgtggtcggcgagagagcttggggggcatagcctgaggggagatggagcaagcgttggttttcagtagcagagctgccctgccccctcccaaaaagtgggtgcaaaacaccaaaaaggtagattttggaatgtcaggctctcaggtaagtcggaaatagggtataattccgaaggaagccactccagcccctaagagcaccttatttctctaacctccaaggaaagggcacaagatttgtcagatacctgtgtttgctggcgctgccacttgctgtgtgaccttggataatctcttaatctttctgagctttagtttcctcatctgtcaaatggggttgagaggaatacctacctcactgttgtggggagttacacagataatgagcgtgaacatatttttgagttgtaacgggctgtgtcgttatgagatgttatcattattcttttctctttttcttcccagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggscgggcctcagctaccaccaccatcactactgctgcagccacctctgtcactgtccctggtgctgggstgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtgsaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccarcacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgyggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagrgtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtytctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccgataacccgtgtgtttgctggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggtgagcgaaccccgcgactcatcgcccaagaactagagggaagcggagggaggtggccccactggagccgatgccagggtgggagtggggcaggtcaccagacatacaaaccgctcctcactcgcgtccctatacgccaggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacggtgagtctctagggactcgccgcccccctacctctgtcgcctccaccgaaaccccctcctctttagatccggcagtgacctcaggcctcagcttcccctttgtaaagtgagtctcactacggggtagtctgtgcatttgaagttccccgaacgctgcccttccagcccctttcccggcggtgactctacagctgcaacttccttctctacactcagaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacaggtagctggggaggggaggtggagaagggtgggtagattctaagggtccagatcagccggtggtctcgctttatggacttgagcaagacatttcgccaatcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtggggtttcccgacaccagaccttgagagacttgtcaggtgatgcgaggtgggaggggttcagaagcaggagcgttttttctctgctcttcccagatctgtgtcttgctctgcaccctcagctttgcgggtcactctttcaaaacccagcactctatccccacctgcgcccacacccggcgctgcggcaatccgcaaagcaaaggctcttgcactctagcgcgttgaccttgcctgacagccccgtgtagggatgtgctgccgctctgtggtccgcaaacaggtgggctcgagtgggcggatggacgcggctggagattggatagctcctattgcactgaaaggtgcattgcagtttgaggcccaggagtcagaagcttttctaggctgggacgtgggagggactgtgcagataattcaagaatgaggagagtctgacctggatatctgggagctctccctcctggcagcggaggcggggtattccggggtagaataccggtagagttcttagcttttctatctggattttatgtcagcgacacagcccgatggacagggcaaccccaaccaatccctgcaccctcccttccctccaccctcctgagaattacccacagaaccagggagacagacttgaaacccacgctgaaaccctcacctctgcctatacctccattcttagtctcaagcccccaccctggcagaagctgaggaacactgctcttgtgtagacagtagctctctctggtggggtggaatatttcctagggctactggctccaccgaggtgatgatgagaatggtctttgctttctgagtttgtttttccaactgtaaaatgtggatactatttcccagctgcttttcttgttgtgactatcaagagatggcactgtgttaatttatccattgattcaataaatactttttagcaccaagaatgagttaggactcagcagttctcagtccacactgttggaggtttctaaaatatactgaaacctgattcaatcccatgcttagcttggccgattaaatcagaatctctggggtggccctgggtgcccttaagggtcacaaagatgatctgatgtagactctgctctccaggaggttctgggcgtatttgccacggataatcctaatgtaaagtagaaagtgaaggacatgcagacagggagccctggaagtgcccgggtggtaagattgtctgtatttcacaaacaactggggtcaaagcaaggtgctgtgctatttatttatttttattttatttatttatttatttttgagacagagttttgctcttgttgcccaggctggagtgcaatggcgtgatctcacgctcaccggaacctccgcctccctggttcaagcaattctcctgcctcagcctcccgagtagctgggattacaggtgcctgccaccacacccagctaattttgtatttttagtagagatgaggtttctccatgttggtaaggctggtctcgaactcccaacttcaggtgatcctcccacctcgcctcccgaagtgctgggattacaagcgtgagccactgcgcctgcctgctatttatttatttatttatttttgagacggagtctccctcttattgcccaggctagagtgcagttgcagtggcatgatcttggctcactgcaacctccgtctcccatgttcaagcaattcttgtgccttagcctccccagtagctgggattacaggcttgtgccaccacgcccacctaatttttgtatttttattggagacaggtttcaccatgttggccaggatggtcttgaactcctgacctaaggtgatccacccaccttggccttccaaagtgctgggattacaggcatgagccaccacgcccggcctgctgtgctctttcttttcaagcatttctgcttgatcagggatttaagaaaatgaaagctgttgtactgatgtaaaattagaaatgaaatctctccagggtccaagatcattcatgattttgctaatatacatttatacttgtcttatcaaatatttttaaatgtttattgacaaatatgcttatttatttatttatttgagacagggtctccctctgtcgcccaggctggagtgcagtgcaggctggagagcagtggcatgatctcagctcactgcaacctccacctccgtggctcaagtgatcctcgtgcctcagtctcctgagtagctgagaccacaggcatgtgccaccatgcccagctaatttttgtattttttttgtggagatgggtttttgtcaggttgcccaggctggtcttggactcctgggctcaattgatctgcccaccttggcctccgaaactgctgggattacacgtgtgagctgcctggccccaaatatactttttttttttttttttttttttgagacagagtctcaccctgttgcccaggctggagtgcaatggtgtgatctctgctcatttcaacttctgcctcctgagttcaagtaattctcctgtctcagcctcccaagtagctgagactacaggcgcccaccaccaggcccagctaatttttgtatttttagtggagacagggtttggtcatgttagccaggctggtcttgaactcctgacctcaggtgatccacccacctcagcctcccaaattgctgggattacaggcgtgagccaccacgccaggcctatactttcttaatatactttgtgtgtatagtgtttaattctcaccattcttttaaaatattatggagtcaggtgaggtgactcacgcctgtacttccagcactttgggaggtctaggtgggaggatcatttgcactcaggagttcaagaccagcctgggcaacataaccagaccttgtctctactaaaaattaaaaaaatgctgggcgcagtggctcatgcctgtaatcccagcactttgggaggccgaggtgggcagatcacctgaggtcgaaagttcaagaccagcctgaccaacatggagaaaccccgtctgtactaaaaatacaaaattagccaggcatggtggtgcatgcctgtaatcccagctactcggaaggctgaggcaagagaattgcttgaacctgggaggcggaggttgcagtgagccaagatcatgccactgcactccagcctgggcaacaagcgtgaaactgtctcaaaaaaaaaaaaaaaaaaaaaaggttgggtgtcgtggcatgtacctatggtcccagctactcgggaggctgtgttgggaggattgcacctttgatgggtgacagagtgagaccctgtctccaaaaaaaaaaaaaaaaaaaaaagagttaaactgtaaaacctttaggtcttgtttattatttttttaaattttttcttttaaatagagatggggtcttgctatgttgcccaggctggtctcaaactgctgggttcaagtgatcctcccacctcagcctcccaaggtactgggattacaagtctgagccaccctgcccagccaggttttgtttattaattctatggattttttttttttgagatcaagttttgctcttgttgcccagtctggagggcaatggcatgatctcggctcaccacaacctccgcctcccaggttcaagtgattctcctgcctcagcttcccaagcagctgtgattacaggcgtgtgccaccatgcccggataattctgtatttttagtagagacggggtttctccagtctggtctcaaactcccaacctcaggtgatccaccggcctcggcctcccaaagtgctgggattacaggcgtgagccactgtgcccagcctgtggatcttttttttttttttaacaattcaaaagtatgtttctggattttgacaaactaagtgaaattgcatactgtttttactctactgaacaattccatgaagatgagaacagtttaaccttataggcctcagaagctaggattaaaaagaacataaaaataattacaagaagaaaaagattacttctacctgaaggacctagacatttctgggaagaaacagcagtgaaagtgaccttcatgtacatggagtatttagatcaggggtctccaatcttttggcttccctgagccacactgggagaagaattgtcttgggccatgcataaaatatacgaacactaacgatggctgataagctaaaaaaaaaaaatgtgaaaaaatctcataatgttttaagaaagtttatgaatttgtgtcgggctgtattccaagccgtccttggctgcatgtggtccctgggctggaggttggacaagcttgatagatgtttgggagaaaatgggaaagacaatgtaaactgaagggacctcatgaccaaagcaaagagatgaccaatgatgaccacttctactaggcacaagaaaggggttctatgtggctggtttgtagggtgcaggagaagcctggaagggtgggttaggggctgaatgttcaaataccttgaaagctgggctttgttctgtaggtgag

SEQ ID NO: 10783 - DNA, 12583 bp, Homo sapiens
ggggtaaagctagcacattgctaggcacgaaggagcatctgaaacatttgctgaaatggtttactgtttacctatccatggatttgttggctcacaattttattgcatcagagcaccatggagaggggtgacagtgcaggtcaccaacccttagttttctgcttcaggaacagttccttgttctacacttagagtcaaagcaaattatgtaactgtaagatgttcaaagatgaagtcaacgaatgcaaagtcagtaactaagtataaaaacctcccccaaggagagtctacatttcttccccagaaatggcctcactgtgcactgctgaagggagagggtcttttcaaagagcccaagaagcaggggctactgggctgcagctctaaatagagatgccattctttctacctgcaggtcctgccaagcctaacagcagacttcagtgatcccacctgaaccaggaattcgggatttttgatgctggttctatttgagccattgtgtaagcttaaaaatgtgacatggagattttgctgtaattgtttctttgctggaatttgacatccacggtgcctctggcttcctctctggtcccaggagggaatggattgtccagcactttttttcagcatctctttgtgggggggggatcaggagatttggagtcaggggcccctccaatctcaccctcttctctaatgcagagtcccttaagctttctggggtgggggcgttggcactctgcggatctcatgaataaaattgttccagctcctgaaataaaggcacaggtgcacataaatacgctgactcttgcatgcagtgccaaggtgaggaagtttcctatgatagatgccgagtttagcactttgactctccattaacattcacacagacacacacacaagcgcgcgcacacacacacacacacacacacacacacacacatacagagtcaaagccagcgatgcgggaggggctgacctcaggggcggggtcacaggcatccctcaggtccttctcagtggactttgtctctttttcctggaggtggaggagtctgtacttcatgagaagtcctctgaagaaagcaggagatacttaggagcggggaagtggagacaaaggggagggggcgaggcaaggggggagcacgcaagaaatggggagggggaggaccttatagtggtcagaaaagtcacacgcagaatttggctcttggtttttgtgtttcattaggatggatttagaaaaccagacagagtgcgagataaggagtctaccttgcaaaagacacgtcttagtgtcctcctagtttgaactcatcagtagtagctgggagaagggagccgggacgcctgtgtggggcacgccctctctagttgttcccattctctgcaccccaccggctggtgcccttcaaccccaacaggaaggaaaggaaggaggggtcggaaggctttgggtcttccctcgcgcgccttcttcctctgccatttattccgagtgtccttgccttccctccgctacctgatccccaccttaacaaagcacactctgcgctgttgggccaggattcctcctttggcctctgactcactggtacaatttcgctgcgtcctgtccttaccgcaattgctactgggtagagccggagagagcatcgcccagacccgctagattcatgcagcgccactgcccgcacattcttgacacttctttagatccaaagtcagagcctgagttttcagactagttccgaaagcctttagccattggaaaggggaaatcaatactctaggaacaaaatttgcttcgactttgtctcaacccaaagacaccatgacggcgcagttttcaaagttgctttgagtataaatggaacagggtctcctgtgtcagactcgattttgcgtttccctctttattatagcccttctgtaaattttattacatgtatctctactccactaaaaacatttctgtcaaagacactaagaaagagtcaatgccatgaaaatatgaaggatactcttaaaagagagtttctggtgttgagttttaattaacactttggtatttaaaaatctctaactatttgggtttggggcttagcttcataatgtttcaaactgagatatactcttccttaacctccatacaaattcaggtttatttttatttttaattgcatttatttttctttttttgaaacaatgtctccattcgtcacccaggctggagtgcagtaacacaatcatagctcaatgcagcctcgaactcctggtctcaagcaattctgcctcaccttccagagctgaaattacaggtacaagccaccgggccaagccaaatccaagttaatactgtaatataaaattccaacatttcagagaaagtgaaaatcaccaagttattgtagtccctggagtcactgtcaagactttggtgagggctcagtggctcacgcctgtaatcccagcactctgggaggctgaggcgggtggatcacctgaggtcaggagttcgagaccagcctgtccaacatggcgaaaccccatctctactaaaaacacaaaaaattagatgggtgtggtggcgagtgactgtaattccagctactagggaggctgaggcaggagaatcacttgaaccctggaggtggaggttgcagtgagccaagatcgcaccactgcactccagcctgggcgacaagagcgaaactccgtctcagaaaaaaaaaaaaaaaaaaaaaaaaaaggccaggcgcggtggctcacgactgtaatcccagcactttgggaggccgaggcgggcagatcacgaggtcaggagatcgagactatcctggccaacacggtgaaaccccgtctctaccaaaaaaaaaaatacaaaaaaatacaaaaaattagtgtggtggcgggcgtctgtagtcccagctactcgggaggctgaggcaggaggatggcgtgaacccaggagaatggcgtgaacccaggaggcggagcttgcagtgagccgagatcgcgccactgcactccagcctgggcgacagagctagactctgtctcaaaaaaaaaaaaaaaaaaaaactttggtgagaaatcttccaggtttttccctacttaaaatatacattatggaagtggtattactggcattataattcagtatatcctcatcttttaaaaaatggttaaaagtatgagacgcacacatcttctcataacaatacttaaaactgatcttacctcttttattgaccctataaaattgtattgcatagcagttctttggaggacgatggaaatgttctacatcttcattgtggtagtggagatgtgggtgtgtacaacagccaaaacacaacgagctatgcatttcaaatagatacattttagatacatttgattgtatgcaaagcaagtcccaataaaatggcttttaaaatatatcttctttgagatttgtactttgcttatgtaaaacaaaacaaaacaaaaaccttgtttttgtgcccaagagacacaccctgacacatcggcaggtagaggcttacgtgtgtatatatattactgtatatttacagattcagagagagagacagagataaagctatgttaagaatattcatacataccaaaactagataaaaaccaaaaataaaagttagaaataataaaactctatattttaaatgttattctcttcttcaccttttttctcctctttccttcctctctcttcccttttttcttcaacacgctccccccacccccaccccccagccatccttccctactttctcccttctctgcacttgatccccggtgtattccagcctcgaggccaacacacgtcaccgcgtccgcctggggcaggtcggggaagggacgcgaggcggcgctgtcaccgcattctgagggccgcagtgccctgcgcccctgctggtcttgtatcatttcagtgaacgtcgctccagtctttgatggggccacactcgggatgtaaatttaggatcctcactgaaggggcgggaccctgagaggctttctcctggccccttagttgtgagttttcctgcaggcggaggagccagtttccgtcagaaccgcccagaggcaggcgctgccttcctggggtggcggagcagctggaagcgttttcggatcctggaatccgtgggcggcccgtgggaggggctgaggcgcatttccctactcacccggatccgaatccaccgcggtgctgtttcaagcgagtcagattccacatcgcgctccaccccggactcggaattcctgccccacaggtctgcattttcacagcggcagctgtgagtgccccgcggctggagaccagaagcctgaaggcaactccgtcctccccagcccacagcgccgttattccgtttctatatcagcaaacacttgtagaccagggcggggtgacgggtgatctcagtcctcgcagtgaactccgggccgcaggcttgaaaacgcgcgcgggcgcccagcccaaccccgccctgggttctgtaagcgaccgcactgggtcctttctctttcttttccggacccagcagtggcgcctaaagtctgcgaggaggaagtcgcctctgtgccccggagttcagaggtctaaggcgagtcctgaggaagaaaacgtagttgatggggcagagcagaaggggctggaggtggggtggagggagagggcattggacagaaggcctgggagacttggtgggggacgggcagccaggcctggaccctggggagtgcctcaccccgagcggaagaccatctgggcttcccctagcccagaaagggtggattggcttcacctctgctggccatcacctctacatgccttggaactaaccttgtatattattattattgtcgttatttaagtattaaaagtattttttggggtgagctgaatgagaccctttgctagagctggcacagggaggaaggtcgtcctggagggagggtagacactgtggagggaagggagacctctgtcaggagagctgagaccacctctctgcccctcactactcttgtaatctttaggagtgtaaataatccccctaaggtggggacaggaccccagtccctgctgtgcgcaatagattatgatgatcaaaataaataatcagtgaatgtggatgggaaatctaagtaattgttaaaaccctgtgatgcttaaattttcactcacagaaatgtgtaggctaggagttttaagaggaatggttagtaattataggtatagttcagttttaaaaaatgtttgtaagagtgacaaagatagaatgaacacagttccagatcatggactgttcatcgtgtagtgggggatggtacaagatggtagatgacagctgggcatggtggcactcacctacagtcccaggtactcaggaggctgaagtggctggattgcttgggcccaggcatctgaagctgcagtgagctgtgatcacactgatgccctccaactggcggcagagtgagatctccccctcttaaaaataaataaataaataaatagtagatggagttcaagaatgcaggcaaagttggtacccatcagggaggttcaaaccatgggctagaacagtggttctaaaacttgcctacacattggaagcacgtagagagctttaaaagatattgaagcttaggtccaacctagccttactgattcaattggttttggctgtgacctgggaccgtggatattaaaaactctccaggtggttctgtgaagtggctaggtttgaggaccactggctagatgttccaaagagtaagagacgtgtgtgttggggacgagatgattctttcagtagaaagaggcttttgcatggtgttttattatcgagatataatttatgtgccacgtaatttaccatttaaaaatgtacagtccagggcccactcagaaccatcccagcaacctgaccacagctggtctttgctggacaccatgaaccacactgcccaaaccttcttcattcctgccaacagtggctgccctcccccgccccccaaccccagctatgagatgctcaaggaggagcatgaggtggctgtgctgggggcgccccacaaccctgctcccccaatgtccaccatgatccatatctgcagcgagacctccgtgtctgactatgttgtctggtccctgtccaacatcctcttcatgaacccccactgcctgggattcatagcattcacctactccctgaagtctagggacaggaagatggttggagacctgactggggcccaggcctatgcctccactgccaagtacctgaacatctgagccctgattgtgtgcatcatcatgaccattctgctcaccgtcatcatcctagtgttgatcttccaagtctgtcgatagatcaggaggcatcatccaggccaggagctctgcccatgacctgtattccacatactccaacttccattcctcgtcctggccccagagctgagttctgtatcagcgctttatcctcacacactcttctacaatggcattcaataaagtgcadgtgttcctggttaaaaaaaaaaaaatgtactggtcagtggcttttagcataatcacaacatcgtgccacagtcgctattatctaattgggaagattttctttttttaaaggctagtcaagtaaagcagtgggagcggagaaggaaaaaagaaatctgtaattggttgtgatcaattagttgtaaacaccactacactctgaccagcctaattgggaagatttaaggatgtgacacggtctaatgggctcagaggcagaagcgacagtaatctggaagcaggagactgcttaggcagtggcatcccggtgggacagggcaaggagattggggagcccacttttactgcaacactggaaagagggatgtcaccagagaaatgggggtggtgacagacaggaggttgtggcagctgtggcttccatggtagagacctcacgtgtgacattcagcacatggggtgctgtgggggtcttagagcactctgactatagctgggacagtcacagtgtttaggaagcctgtacagtgatctaggctgaatcctgtgcagtgatctaggctgaaagccgagactaaagtagtggctgtgggatcaaaatagggttggaggagctttgagtacttgagaaggaaaagggggaaatcagaaggcaccacggaaagagaaacaggggaggaagagaggatgatgtcatgcgagacgtgtagagtgtccttgtagacctgtcacattggaagctactatggtctcagaggtacagatgtcctaaagcaggctggaaaagggagtctggggagagcttggtgttggagtggacactggcaagctgcctccttggccttttgatcacccaggggctgaatagagaggcagccccgggagacctcacacacttacaggaagtgaccataagaaaggggacctagctttgagtaaaagggaggagaaggagattgtaaagctgaaacgtctaagagatttgtcgtcttagcggatcagctggggcaggtgcttcagaaacagaggtagctgaggtctggaaacaggtctgcaaatctggtcactggccacatagccagtaacgctgtgcgcggctgaggggagtgtgttggaagaataaccaggcctcgtctcttctgtaagtgtgtcctggaaagaacaagcgaatgacagtcagcttgatggggtggctggcgaaacggtcttggtgaggcacgctatcctaggggtgggggtgcggggatggggtggtcgcaatacagggagggcggcagggcccaggtcgtgctcatgcggttggggctgtactctcagctgctcggagccagtccccgcatttggcggcgcttccgcgcgctcccccttttctgggctccaggtcccgccagccaaagttctccaggtctcctgaccgctggaacgttccccttctgagtgtggccccgccctcccagctcgtgattggccctaagctgcgggcgccagttttcattgggtgagcggtcgctggggtggggccaggtgacaggaaatttctggtgggccttcgcggctccgctgggttggcagccgcttgagccactgcgaggaaagcaaagtctgggccatggagatgagcctagtcctgctgttcctgatccgcactgccctttttgcaccccagggagctgctgctggtaagtggggttcctggcggtcctcggcggagcggcagcggcggggcgtttctgggggtccgggtgggtagcggcgagcgctgtgcggccgaggcggggctcaggtgcgctgtcgggggtgcggggagtggacgcggcccgttcccgccacacctcaaccctgcttccacgtctcttttcagtcctcctcgggatcgctcatcacccgccccctgcattttctggtcttgtcctgcactttctctcctctcctctcctccgtctcctctcacttttcggacaaaccagtctttctgaggcccctgggttcctgggctgctcctgtgaatggcattcgagggcccttccagcgcggccgctgaggcagccacctcccccggtgctgggggcggccctaaggtccctgaagccctgtcctctcccggagccgacgtgttctcagctcctgggccgcatctcctggagttggggccctcctttctcgggacccggagctagtgcttcctgctgctgtggggactgtggggctcctgaccctcacgctgaggggttggagtctgcaggctccgggcagaggattcttcctgcgacttctctcatccccagctcattctcccctggcctcccgctgccggggatcctctcttgtcttgcatccttccctgctactattaactccagtgatctaaggacaccagattccctcccacctcctcccctgccctcagggcaccttgggtcctgttgccctcccagctccctgttaccccttcctatctgcagttctctgatacatttctaggatgtcctctgcctcatcccctgcccccgccaccgcaggtccctcctgcctcccttatgggcctttcctagaagcagccttaacccagggctgcccctatgcctcccactcctaactctccctgaccctaactctctggtgccgccttttgtcccagggtcttccctccgtcccactcccctctagaccacccaaggggagccctagtgctaatgttggttgggccttaggcagggcacagggcagggcagatgccccctcccctctagtgcaggtgcctgctctgggccctgcctcacggtggccccttccctactccttcatcctcagccccaccctcttgaggaccccccactccagcccacgggtgctggaccatccctccctggtccctccgcccctctccgccttgggaccttgtgctgctcctacctcttgcccagctgccttgggccctcagcaagttctcatctttcccaagccccaccctcactcagagcaccctcccctcctgtcctcaccctaaccaaagttcccccagggtcacccccacaccatgctcaccccatcctccagtccttgccctgcacatctgtcctcctctacccagacccaacacaggccgtgtgtccaactgcttcttttttttttttttttagacggcgcctccctctgtcgccaaagttggagtgcagtggcgcggtctcggctcactgcaagctccgcctcccggattcaagtgattcccctgccttagcctcctaagtagctgggattacaagtgcccaccaccacacccggctaatattttgtattttaatagagactgggtttcaccatgttgaccgggatggtctcaatctcctgacctcgtgatctgcctgcctaagcctcccgaagtgctgggattacaggcgtgagccaccacacctagctggtaattcattttttaatttttggaggaatcaacacactgttttccataacaggtgccctattttgtatttccaaatgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtgtctgttggccatttgtacatcttgtttggggaattggctatgcaagtcctttgcctacttttgtattagttgaatgtctcctgtttgagttgtaggagttctttatgtattctggatattaatctcttatcagatatatatgatttgcaaatattttctttcattctgggggttgctttttcactgtgtttattgtgtttttaatgaacttttttattttgatgagtccaatttatcaattttttctttgtttttgtatctttggtgttatatccaagaaagtgctatcaaattctatggcatgaagataattccctatgttttattgtaagagtttttcagttttagttcttgagtttaggtctttgatgtttttcttagttaattttcatatgtggtgtaagttagggatccaacttcatttttttttttttttggcatgtgaacatctggttttcctagcaccatttgttgaaaagatgcactgactctttaagacccttgccaccagcccaccccaggggacaccaactggtccatccacctccctacttggggcattgccatgccactctgaagcccacaccattgcttctccctgggatatggacctcgtagaaaacgtctctggcaccacagcctacctgcccctcctgcctcacagccaagtctcccttgcccccaccttgtccatgttgagccttcctcaaaggcagtggaccttgcctccatctcaccctcacctgtgcaccacagccatggtggtcatgggtccctctgagcctgggtcccttacagtttctgctctcccctctggcaagaccttccttccaccactgccttcatgctcctcccttgaacctgcagggcagccccttccattggcctcctccctataccctgagggggcctgtggctgccctgccctggcacctggcctacaagtttgccatccccattcccccttcttctgttcctcagtcccctcctctatcctcccaccttcccagttttccttgcgtctgaaatcctcattcttgtccctttgcccgtgtgcatttcctgcctcctcaggaaggtcgggacagcagacctgtgtgttaaacattgatgtgaagttacttccaggaagaagtttcatctgtgatttcctcttccccagagccccacagtctttgttacaacctcacggtgctgtcccgggatggatctgtgcagtcagggtttctcgctgagggacatctggatggtcagctcttcctgctctgtgacaggcagaaaggcagggcagggccccggggacagtgggcagaagcagtcctgggagctgagacctgggacacagagactgaagacttgacagagaatgggcaggagctcaggaggaccctggctcatatcaagggccagaaaggaggtgagagtgggcagtgggcaagagtaatgggagaggccttttccaggagagttgggggcagagagcaggacctgtctcttcccactggatttggctgtgagtaggggtgaggaatggtgctcagcggggctcagcccacacagggagggatggaagagggccagggaggggtccttcctggtccgagttcctcacttggactggaatggagaagtcactgctgggtaggggcaggcagccttgcattccctccaggagattagggtttgtgagatcaggaagccagcagcaccaggggctttaggcatttctacacatatgggaagctcttcctctctcccaacctggagactcagtaatggacagtgccccggtcctccagagctcagactttggctatgaatgtcacaaatttctgggaggaaaatgccatgcagaccaagacacactattgccctgtgcaggcagactacatgcaaaagctatggtgatatctgaaattctggaggtatcagaaaaacaggtactgtgaaagtagtgggtcctcctatagaagcctgaacctggggtgggcattaggcaggaaaggaaggcctcaaggccagggctgcctcatctgcctcccagcctgcccatcctggagagctacctcctagccccacgacccaggagcccacccctgacaaccctctcctcagcatcaaagccggagtcccagagtgtgaggccacagtcctgaggcccatcttccagcaagcctaggggaattggaccccaggtaaggaccgatttgcagaaggtctggggtcagtgtgggtttcagcgagagtcagaacaatagagaggaccagtcctgttccctgcatctcccttagaggggagaaaggcttggccacatgcct

SEQ ID NO: 10784 - DNA, 24875 bp, Homo sapiens
catgagccactgtgcctggcctatactacatttaaaaaaatttttttttcttcagtaatcagttcaccttagcttactgtaacttgtataaactttaaaatttttaactttttgtctctattgtaataacacttaaaacacaaacactttgtacagctatagagaaatattttctttatatccttattctataagcttttccctacttttaaattgttttattacttttaaaacttttttgttaaaaactaagacacaaacacatatatattagcttagacctgcacagagtcaggatcatcaatatcacttttataagtagcagtaccctctaaaataataataaaaagtatagtaaatacataaaccagtaccagagtttattataattttcaagtgttatgtactgtacataattgtatgtgctgtacttttatacaactggcaacatagtgtatttgtttacagcagcatcaccacaaacacatgagtaatatgttgcactgcaacatgaagatggctatgacataattaggcaataggaatttttcaggtctattataatcttatgggaccactgttgtatatgtgatccactgtttaccaaaagttgatacgcagcacatgaccatacttgctttttgttttttatagtctttcagctggcaagtttaatccctataagctcactggaggtatgatatctttgtatagatgttgctgtacttaatgatggtttgatttatgatttttttactttataaggatgtgaaagcaatatgcatttagtataaaccatacttcaaattttgaattttagttcaaagatttttataactttaattgtaaaacagacgttgtgatttcgtatatatatacacacacacacacacacacacatatatacatataacctactatcatttgttaaaaagacctttccctgtcattctgcagtgctacctttgttataaatccagtgtccatatatgcatgggtctgtttctgagctgtctatgctgttcctttggtctatttattcttgcactagtagcacattattagttactgtaactttataataagtgttcatatcttagacaagtcttgtccccttgtttttctttggtaagagtgtcttggcttttctttgcatttcctcatcccttttaattcatcttaagggcaactaactgatcctagagtgtagctttaacttgatacacagttcatgctagtttattgtactttaaattagacaacataacactagtgcccccaatcagaggaacatgcggttgcatcttagggagatcactggtgcctgtagccaagtagcctctgagagactgtggaccagatgggatgagataaatctggtgtgagaagctagtgaaggccaagaaattgacaccaaatttcaccctcctggattttagcatcattcccaaggaggagatggaactcaactattgtgaacccaataacgtctgtcttgttcactattacattgctgttcctggtatataatgggcattcaataaatatttgtcaaatgagtttacatacatctgcatacagcatatattatatgcttctcagatgacatttatgtggctatgagtttcactaccttagatgctaggatgctttaagctaatttttccccagctttattgaggtataattaaaaattaaactaaatttttaatggcctgtgacattttgtcatttcatggagttgcctttctgtttaaagtcttatatgtatcacctcaagtcttttagcaaataagtgatacagatttttttttaaatgttgaaacaaatgattacctgtcagtgattttaaaagtttgttgactttctacattcctaagtggaattaacttgcaagttctaagttcatatataaaattcaattcaagatcatgtctagattttcatatttcaaaatactcaattttttagtagagaaactgccaagttatcctgtgtttttccattttgattttactttccttcttgaaaagaatacagtcgatgaaacttaaataaatacagcacatgttgagttttctgccctaagtgttaaaattctatgttttttaatgcagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaagatgcttatcttttcattacatcattcactcattaattcattcaatcacaaaatattgagtacccaccatgtgccagcaactgttctaagcacttggaatataccagtaagcaaaacaaagcccttacccctctgtggagcacatattggtggagaggaggggattgtacaatgttagtaagcaaggcaataaaactgcatatctgatggtgatacgtgtaacgacggaaaataaagaagggaagggaataaatagtgcagggacagggagttggggggaggcttgctatttttaatagggttgtcagaaaagatctcactgataggtaaacttgagcaaagacctgaagaaggtgagggaatgaggatgaaaatacatatcgggaagagagttccaggtggaggaggttaaggtccagacaggagcttagtatattcaaggaaaagcaagaagactagtatggctgacaggatgagctaggagagtaataggaaatgaacttactgaggtttttctaatgacctgggcttttactttgaggtaaggagccagtgaaggtttctgagaataaatggtatgatctgccttatttaggattgctgtagttgctgcactgagataacatgtacatgagaggcaagagtagaagcagggagaccagagaggaaggtattgtagtattccaggtgcaaactcaccaggtagcttgaaccagaatggtggcggtagaattgggaagaatctggatatattctgaaggcaaaattgatggggtttactaatggtgtggatctaggataagagagaaaaagagttcaggatgattctaaagtcacttgatagactttcaaaccactcacaaaatgtgttttgttttcgtttgtgtcatgataaagttatttttaataaggtcaaataatcccctaccccaagagttaattaggatttaaaatgagttcagagggaattgggatccagccttaagggcttcaactctgttcaagtatttaaatggctttgatctctgattaaaggtggtggctcagctttaaactattattatctatcattttctgtgccctgtacattgtcatccttgcaatgagaggcatagagctatcaggagaggggactaaagcctaactttttaagtagactaatctttgtatcctcagctctattccgtcttttaccgacagctggtgcctgacctagaggcctactgcatcttttttgttaacaggatttttaaaagttgaggactttttaatgccaattatttcactcagaatatttatttatttatttatttttttgagacaaggtctcgctctatcgcccaggctggagtgcagtggcgagatctcggctcgctcaacaggaataattttaatagcaaaaatttaaaaccccttcattaagccaggcgtggtggttcacatctgtaatcccagcactttgggaggctgaggtgggaggaccgcttgaacccgggaggtcgaggctgcagtaagtcgtgatcgcgccactacactccaacgtgggcgacagttagaccccatctcaaaaacaaaagaaaattagaatggtaaaaatgaagtaaattcactttgcttcccacatctagctagacagggaaagatggagtagctttttcttttttacttcatagcttcagtgttgtccgggctttcattactctcatctcagtataaagtggtaacaggaaggtcaggtgagtgtgggctgcctacgagctgtacttactgccttctgtttcacaaaaggacgttttctccccataatgtcgttgttcttgctttgaattatgggtgctgggagaaactaaacgaagccgtcactgagcaatacacccacagcccgtcgaccgataggaaccttcgcgtggggggagttggttacttttaggttgcatgaagaggcggggcctcgcggggcggagctgggggtggtctgtgggtccgcgcgggcttcgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcaggtgagctccgggcgggcggtctcgggcgttctgctcgccgcgcgggcggttcgcgggcggttagcggacggaggccgcgtgtggcgggccggggcctggggcacagtgaggctgcggcaaccgaagttgcttgttgagatttgttgtggatggacgtggtgtagttttgtttgtttcttggattatctcccctagtccgagagaaaacgcattcgatttaagctaaacctgtgagggcgttatcggtggccacactttgattaatttacctaggtgttagggagcggaaaaaaatcagaggagataaaagttacagtgagattccatgcgattaaggactgtggcagcttgggtctgcagaacttctagaaccttctgtgtggccccaaacgttttaacttactcttctcgttatgcattttttaagggaggcagcagtttacagtggccctccacgtgaagttaagtttccttgcttcagaacaaaaatgaataaaacaaaaccaacccagcaatccattgagagcaaagattagacaggagtgaggggtaggcagtaagttaccgggtgcttcgtgcagcagagacgttgccgcttctgtttctcccctaacctcgcggacgggattcagcggttccgttcgtctctcggtatttattgggcacctccctacatagaagactaagtgctagttactggcctgaaagcatgaaaagatagttttccccttttcttgcttaagaatttatttggtaatacagtagtagacttgtatagaatttctaaacaatttaatgttaatagatttttggaaagactttaacggtgtattgaaaagttttatctacttcctgtgaacgtttgtctcaagttactgtgtaaattttgtgagcaggtgtagttaaaagaaaatcttgttaggcacctgcaattccgtgaaactgtacacaggagttggttacatagttttgtctaggttgtgcatgagcaaagaagcatgtgagccaaaaagtttaggaaacactgcatgtgtgtctttatcttcctacattaatacacccaaacatgaagtatctgtttgctgagaaaatacttcaataaccacggtatctcttaacaagtgaggcattattattgttactattgggagaaaagagccagagagtgagagattctccactcaaaataatttcttggattattaagccctacaccaggttctggggttccactcagaatgaggcaagtggaagagagaagtaatgcttcctcatggattttcacaatactggcaaacctgaccgttccactcccagaaaaagtagagcgaaagtagaaattggtggcctcagttacttgaagtccctctaactggtaatgtttctttttagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtggtaggtacaaaagcactctgaagtgctcctctttaaaagaaagcctcaggttttgaatattattatattctactgtttgattaatgtaaaatgaattctgattgcacatcagtgattaaattacaacttgcttaattaacatttgagctgaggagaaaagtgattaatatgtggctgttcatttcaaggacttttttttagtaattctggacttttgtaggccttttttcttctttttaaaaaagtaatactagctgaaaaggaaggatttccgaaggtaagcaaaaatagagaaaaatgctaatgtagatcctattaaagttttttttgaaaccacatgggcaatggcactgaacactattaaaaactagaatcatgcgtagaagatcgatttttaaaagaaaacatgaaactcatatgtaattttgctctaatagtttgattttgttgactaataaagtagtgtaactgtgtagaataaaaccttatagtttgtacttagaagtgtgcacttaatgttccctaaccacactgatcctgtcaattgtggaagaaatttcatactttatgacctggagtatgaactgatctacatgatgtttaaaatgtttggcagcagttttacaaactgttaaaggatttccatttatctctaatggaatttatcaatacagtagcccttttttttggactgcattttgtcttctgtatttcttccttctacagaggtgattcccttttctccgttttgacgatcagttctaaatggactctgagttttgcattcttcagtggctcaaaccatcttgcttactattgttactttttaacaattattgtaatttgtaaaaaatactatgatattacgattctctctctctgtatatatacaacgttttcctggctcataactcccataacccttgttacagtcttatgttatagttcctggctcataactcccataacccttattacagtcttacgttataatgttggggtgctttaggcctcaggaaaaagaatctctctctctgaccttctttcacctgccttacctctagtctgattgtgggtcaaaagactctcgttccagagagggtcctgccctatgccctggaggagggcatttagcacccagaggccaagaagaatctgaatagactggccttgctgggtttccccattcagtctgttagagtgagggcatactctttttgtccaatcacttttctacatggttgtcattcatgcttatataaaagaagcaagcctccataagaacccaaaaaggacagggtttggagagcttctggatagctggacatgtggaggctcctggaaggtggtgtgccccttccccctgtacctcaccctacacatctctttatccatgtcctttgtaataccctttataataaatccgtaaatataagtaagtgtttccctgaattttgtgagctgctgcagcaagttaaacccaaagagggggacatgggaaccccaatttgaagccagttggtcagaagttctggaggcctagacttgcaacggtggagggtggggtcttggggactgagctttcaacttgtgggatctgataccgtctccaggtgtagggagtgttggaactgagttgggggatacttagctgcaaatcccccacatatttggtcacagccttctgtgttgttacagtgtgagagcagaggaaaaacacagtgtgagagttttttctaaaacacaggctaatgtttattcatttaatgtacacggactatgtgccaggccccatgtcgttgttactattatcaccattctacagatagggaaattgaggcttagaagcttaaatgacttgtccaaagtcacacaactagagagtagtaaactccaaatttgaacccaggaagactggctctccaggctctaatactttatgcctgaattttcttaaatatatcacatttcaaaatatagaaatgatatatggatgaatagatgagcttcctctaagagataaaaattcaatctaaattggcctttaattcagtggatattgaacacccactatgtgttaggtattgggtagctcctagaaagctcaagatggtaatgaagatgtttgggggatgggttttggagactggcagaggggaaaatgataggactgggagattggcttttcatatgtttcccaaaacttataacacagtggctccttctgccttcctgtcagcctttcactgtggcttaacctgcacccaggtagtgaagggatggggttgggggtgatagggatcattcgtctggcttaaagtttcatgttagggtgtgccagtgttctaggagtcacaaaacaagatggcatcatagttaatactgtgtgacagcctgtaatttaaaagaacacttcatatatgttatttgaaactttaagaacccttcgagttaggtggagggcacatactctctctcctagaaatgagggaagtgaggtccaattaggatgaagtggcttgcctgaggacatgctactgaaaagtggctcttcacactaaaaacactagtcccttcttttacaccaaaatgtcttgacagtaaatgtaatttaacattttggtgattaggaaaacacttcagaattttacattgcctaaaagtgatcattatagcattcttttgatataggagtatggaataagagacagaactatgagttttaagaacctgttttaggccaggcgtggtggctcactcctgtaatcccagcactttgggaggctgaggtgggcagatcacctgaggtcaggagtttgagaccagcctgtccaacatggtgaaaaccatctctaataaaaaattcaaaagttagccagacgtggtggcgcatgtctgtagtcctagccactcgggaggctgaggcaggagaatcacttgaaccctggaggtggaggttgcagtgagctgagatcacaccactgcactccggcctggacgacagagtgagactccatctcaaaaaaaacaaacctgttttagaaattatttctttcaaatcatggtatgagcatttgccattttccctcctttttatgaaagcacaaattttcatcattaataaataagcccacattcataatggtaagaatataatagctattaatactataaatatatgccagtgccaattctagacacattatacatattaacttgtgtgtgtgtgtaatttttttagtcagtgctatcagtcactgttaaactctacctgctttacttcatttagtcacaagcactgttcccttatcatccctgtttcataggcgactgacccatttgcacagctagtagtggcagtgctggcgcagttttcactgcatactctattagctgacatattaatagtagccacagtttgcgcaaaattgctgttgtactcctcctaagtctcccagcagtttgccgtttcgatactgagactgcagaggtttgtgaggtgcccaagacctgggkactagctgaggatgcatgcgctccggttttgtcttcctactgagtactctgactaaaatttctttttgtcaaagcctacttagttgtgatttcatgcagggagttttccaggagcacagcccaggccagccttgatgtgaggaaaagttctttcccaatttggacgtgtagctgcttccgggatctgttagtaaaaacagaactgcccttctccgccagaagtgttgccagatgagatattaagaaacatgaaggataaagtgagatggtccaacatttctctaaccagagttccagacgaaaataacagaaggggagacagggaatattcaaagatacaacagccaagaattttctagaactaatggaaaaattgtagacaaaagacgtgtatatgagtttaaggatagcaatagctgacaaacagtacaaacgttacttaaactaagtagagatctaggttcagctttttaaaagaaaaaatgtaaaatatgaggtagacatattttagactgtagagtaaatggatgtaccagggccaaaaggagcatgaattgccttaagggagaggargggggaagctaaggaaacaattcctgctgaagcaattgggttttgaaaaaggtgatcccagtagacaagggtcagggagaaagaatgctacctgaagagggaataggacatgaaaagcccatgttgccaaataaaccctgagatctttacattttgaagaatracattttacccttgcmtgaaatgaaaaaggtatacataaaaatgtatataagaagttctataaatgatgaaatctggttttcacagggataatgccctggtaatttctattatgtattaaaaaaagccttgtgggatgggggtgggggagggtccctaaaacacaaactttagcagttccacctaactatttggtctcatttaatgataaaatattttcgtcatatgacaggcttattatattttttctagaatgtcttttttatctattttgttaagaacatgaacttactgctgtaactcataaatgaaaccttccttttcagaatagcattgttctctcttatcatcttacaattgaatacaaaccgaaaaggtgttgaaaaattaatctcttctttcagcatcttctcatttatcaatcacatgattcacctgtgtcatttgtctaaatattggagtcatggtttgtgcttttagcataaatatttagtgccaactccgtctctttcctatgttctgggccctagtttatctttctgagagattgctaatgtaaaatgtttaagtaaatactgaatggtcctggaatagggcctgatacttgcattactattagttagtagaatatttgtattttgattgtgttctctagccaaatttgtcacatgcgattcttcccagttctttgcttttactggctcttataaacacactttgacatatatttaatatcttgaagaataaagatatcctgtgattttacagcctgtcagtactattttggggtataacaggtgggtaaccgaaggggaaaaggcatgtgtgtgcttagggcagggagaggatccttttatggaattgaacgtgctaaaacattggtgaagttgttctttctgtgcacacttaagacagcagttaggattagatctttcatgaacttgtatttctaagaccatccaaatactgggaataggtctgtcactttcattttgcaaaagttggcatcttagttactgtaattcataataacaacgttccctggaagtatagaacatgttaaatatacaatatatatttctttattttgcccttattccacagcttagttttttagtgactgggtatattcatgtgtgtgtatagtgtgagtgcatgtgtgtgcaattgagtgaagtgggaaagtagtgcttctatagtttgatcagggctttacacaaaaaagccacagagattttcccttaaatttgggaaaagacaaagatacccccatgattgccactgtttaatacagtactgaaggaccttttcttaaaaaaaaaaaagtaataggattgggaaggaagaaataaaaactgcagatgatatggatatgattattaacctagaagaaccaacagaatcaacagactgaacactaaaatgaatacatgtaaatcaaggttgccagtgacaagataaacctacaaaaacagcacttctcaaaccagtaaaaatcaagtagaaaatacaaattcacaatagcagcaatatccacgaagactactatgaagaatacatgggaactctatagatctgaataaatgaagagacatatatcatgcctttaaacagagagatgttataaagatgtctaatttctcttgttttttgagaaacacaataaacttaccctagaatttatatggaaaagttggagaagtaaaagtccataaatagctaagttatctttaaagaagattgagggacctgctctatcaaatattaaagtgtagtacaaggctagtgctattaaaaaaaaaaacccaaaacttggcactggtataagaacagttaaatacactaatgcatggcatagagattttagagataaatagcgaatatacattcgctaggggaaagatggattgcttggtaaataatgttggggaaaatggctatttggaagaaaaaaacaaaacattcttacctaactgcatgcaggggttgatgctaggtggattaaagacataaatataaggaaggtagaactataaagttaataagagaaaatataggaaaataggaccaaagggtgggggaagaccttaggtcaaaacttcaaaagcatacgccataaggcaaaaaaaaaaaaaaaattgatcgcatcaaaataagagtctctctttagtgcaagacatcccagacgtggttcatatatgagaggatgagagatggttgcaatgtctgtaaccaacaagaatctcttgagtatacaaatcaacaagggaacagtaactcctgtttaaaaatagaaaagcaaaataggaaaagtctatgaataggctaacaaggatacaaagagatgtctgaaattattaggaaaacacaagttaacactgacatatcagtgtatttctgtcacactggcagcaaatagaaagttggaaaatgcagaatgttggtagggatatggggacccctgtgctttgctgtggagagtggataggtacaggtgttctgcagaatagtcataatactaagtcaaaagcagagtacacataccctttgtcttagcagttctgtcctggtatatgtcctaaggaaatcctcaccaaggtccaaaggggagatgtattcatagaagtgttatttgtagtaatgagaagctggtagacaacctaagtgtccatctctgggagagtggagagggaaaatcaggtaggtatacacatggagtattatacagcaattagcagcaactgattagaagtacacatagggggctgggtgtggtggctcacacctgtaatcccagcactttgggaggctgcggtgggcagatcacttgaggccagcagtttgagaccagcctggccaacatggtgaaaccccaggagtttgagaccagcctggccaacatggtgaaaccccgtctctactaaaactacagaaattagccgggcctggaggctgaggcacgagaatcacttgaaagcgggaggtggaggctgcggtgagattgtgccactgtgctccaacctgggtgacaaagcaagactgtctcaaaaacaaaaaacaaacaaaaatctagcaacctggatgctaagtgaaaaaataaaaacagaatgagatataaattcaaaatatacaaataatacagatcttgtaaaaaacaaatagtattaattagataaacacgaaagaatgattgccttatgagctgggaggaaaatgggagaaaggcaagtgtatagaaaaatgaaagaattttaaagcagaaatgaagaatttttgaaaagtttggtgatctttaaacttgatttgggttgaatgagagataaagaaaattaataggaagaacatcctgcatacaataaccgttttgttttcccaatttctatagggttgaagcyttgagagaagcagcaactgctgttgagcaagagaaagaaatccttctggaaatgatccacagtatccaaaatagccaggacatgaggcagatcagtgacggtgagagccatctccacagaaggggctcatcttttacactcctttaaagagtttatgataagtgtgggtcaatttttgcttgacttttggtatgcgtacaccaggccacagcatttaatgtgagccacagagagcagctgcagctgtcagttcattacagcagccacttactcagagatttcttccagcatgctctctaccccaagcccctggctaggagagataggaaaaagcctgcaagctcagaaaagctggccccaagcagtaaggccatgtgttttatcccaggttcacagtcctaacttcagttcctcacaagttactggactgcaagagattaaaaaagcagaggaagagggtgagagagtggaagcagagaagtagagaccaaaaaaaaaaaaaaaaaaaagatgaattgaggtacaacataaagagaagggacaaaatgcagagaaaatgaggaaacttgtaggaccaataaaaggcatgaatgtaaaaatgtgctgtcattttcttttttctttttttgagatggagttttactcgtcacccaggctggagtgcaatggcgcgatcttggctcactgcaacctctgcctcctgggttgaagcgattctcctgcctcagcctcccgagtagctgggattacaggcacgtgccaccacgcctggctaatttttatatttttagtaaagacagggtttcaccatgttggccaagctggtctcaaactcctgacctcaggtgatccgcctgcctcagcctcccaaagtgctgggattacaggcatgtgacatctgcctaacctgtgctgtcattttcatgtgaagaacatgaaataggaataggtcacttctgattttcttttattggcactggacttcctacttgggctcctttggtgccacacaggccacatggtactgggccaagtggctggtgaggtaagtaagcaacctaaatccagatcaaaactgttacacatctataggtaggccatgatctagtctctacgctatcctgcccaaagatcaatgaattaggaagttacagaagcaggagcttgctgactttctcatataaataatgaaatgttgatagagctcctcgtgctggccaagactttagaccactgtcctgcttctatctggagaaggatgaagtcagtgcctagtattgacgacagaagacagcttatcttctatcgtggctacattttctcaaccaaaatttggggcattgtattctgataaatgcacatgtcgttctggagagatstgggacatctgatctctggagctctacccagcataaaccctatatgtgcttactgctcacagtgttaagacttgatctccatcccagttacaaatgcatacctacccaaacttttgcagacatgccaatttgagaagtcatctggtatcccatatatgcagattgtcaggaagtggtattctacaacctctttctgtaatctaatacatttcatcagttaatcttacatgctrtagtttyagcttttatctctaaaaaaatttcatggcagaggtaaagaaaataataaatttagtcacaaacaaatgccttaatgtttttgacacagataagtttacatctcatattgatttttaggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactstgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttccagcactgagcattaatacctagtttgcattttgtttactaaaaaggttgaccagtgtgttgattcttcttttatctgataaagtgtgaagcaactagagaacacttatttgttcaaagtaactagtcctattgatatacaaaaaccacaacaacttccctggatactattttgaaatgaacacatcaatttttatttgaatgtaggtattcttcacactgaaaaaccaaatcaagatccaaactgactttatgtatgtatatatctctcaatgcaagcaatatcaaacttcattttctctacaaaaatgccaagttagtctctttataaaaagcagttacaatctgaagacattcatgttacttcctttgccagctccaactctgccttatttaaatctttgcatttcatgggaaacattaattctatctatggcagagccacttggtttgttagcagactgatttgctgtcatcagactgtgagatgattttttgtgtgcatcatttttttcttgaccagctttttgaaaattaagaaatggatagtcatgttttcttcaggttctcaagtattgtcagcatccgtaaatcccttccactctgggaaatactactgctccctgcttcccatggcttccacatcagtccaggactttttctacacaaattattctggctctgcctccttgaccttggtattcttagcattatttttcccatttttttgcaatggagtttttaatggaggtcattgatttctgatcacagacttgaagagctatgatccacatttccaagctgcttggggtccctggtttacagtgtctccagcattctgtacctagagccacatctaaagggcagggaatctccagtgtggttttttgtttttttgttttttgttttggagtcttgctctgtcacccaggctgtctgacaagtagaagacatatccactgtagcaaggaacactatggagtatatgagttagggaaaagagactgtgaagggaagagaacaaacattttgtagacgtttggtgttgaatatatgctatggaggcagtttctatagtttcatttacttcatgaggtttcattttttcttttctgagatggagtcttgctctgttgcccaggctggagtgcagtggtgtgatctcagctcactgcaacctccacctcccgggttcaagcgattctcctgcctcagcctccctagtagttgggactacaggcgcccaccaccacgcccggctaaatttttgtatttttagtagacatggggtttcaccatattggccaggctggtctcaaactcctgaccttgtgatctgcctgccttggcctcccaaagtacagggattacaggcatgagccaccacgcttggccaatgggttggttcttaacatgtatttttatttataagaatgggagtataatttattttcaaatgatgatgaatctcctgagtcacatttttaccctcatttaaactattgtcttttatatagactataagtggatatagagtatgttttgctgtatctcaattctctaccattcctagcatataatacataattttagggtagccctcctgccattccttgttagcactactttcaataaaatgagagtattaaatattggcagagtatctgaaatatgaaataattttaggttgctttgatctttaaagaagttgcattatatattttactatttagatccacactgttgatacaatcatacatatcacacaaaattttagctttgaaatgcatttattttctgattattggaattcatccttcatgaaatttttagagtagtgttttaaattaagctccagagtgtaactgcaaccaaatagcaatacatacaagtggttttccattcaaatttacaaaagcattatttattagtaataaaaatatagaaggaattcagttttccttttatccccaattttttgcttttaaaagaccatttactaacatcctactgtagatatttcgagagacagatgaaaataataataataaagattattatagccaaatcatccagttagccaggagtttgatgactggatatttcagagtctactgcgggttttaaatattttgttagcaaatgaattcatctgtatgatgagagacttacatgttttatagctgaaaacctaaggagtgacaatagtacatgtgacattcttaacagttaaaaactgagtaagtcctgttcattaggtaggtgccatgtggaacaagctttcacctcatcaatgcattttgttttcagagaaacagactaatgatagattaatgggaacattttatcaggttagcagtaactatttcaaaggttttgaaaagtatgctaataattaacaatatcttatattaaaagggtccaacactaagttgggacattaggtcctaaggccaactccctattctaaggtcttcagaaaaggtccagtttcctaaaactcacaggtccaaggagtacatgttatttattgagagttccttctgagcactgcactgccaacttctaaagcaaccacctagaacttcactccataatgaggaaaaagttttcatcctctttttggtagttttagctttattttgaaaaagtaacgtgtgctatcaactttgggcagatacaaaggaaatcatttaacctggttttatttaactatattgccttatatgggtcattctatatactatttaattcatagacagagactggaaaaggaaaaggaaacctgaggaactctgaaatatggcagttattccacagcgatatgtctacgcaaaagattagccgtaatgttaaaaaagtagattagagcacaaatgcacaatcacctggaatcttggaaaagtttttctttagtatacatggtttcataaaattaaagttatttaagagaatgaagggtcttggaaaaaaaatgtcaatttttgaaggctttaagaattgattaaattgagaaattaacatggctgactttcaggcctacttaattattttaaatgactaattatggttaggtttaaaatacagcagtgcaaattaaaaattcaaatatgtaacaaagctctctcttcagttcttatttaaaaaaagataaaactaggtacataaaattatattacaggaactgtaactatcctcagagattactttttttaaatatagaaaggtaacacgcttttagccacacagctaacatgaaaaagaactaactagaacacatataacaagtgatttttctgccaataaagacaaaagactatttgttgcaaagtattattttgtgcaaaaattaaagaggagagtagagagtagaaaattgaagagagtagaaaagatgactcattagcagtatccactgtttgttaggaactgaattttgcccccaaaacctatgtcactatcagcaatgggagtggtgacaactggtgacataaaaataagcattttacattactgtgaaatagataatgccagatcatttcaatataatgaaaagcaaaaatttactttttaattttttttatttttccatctaaaatggcaaagagaacatttacttttgatcacttaacaaggacacacccaggaaatttgattttctcaacattaggaggatgaggggagtacagatggaaaaacaaaagataaaacacaaaaggagtacataaaacattgtttagtacaaataatgaaaaatgacttcatgacattttccaataaaagttatttttacagattttgcaatgctgtaaaaaccaggtatattgaaaggggttatttataggttaaaaataaagccattgatgagtgataatcagttttaacagagttcacgcaattatcttagctggaaagctactgtcccaagtgacaaaatttatgtcctgacacatgattacatattaaatcattttgtaaaagaaatgattctgtatgtgggactgacagctcttgagaaagtgctatacaaacaaggttatagaaatgttgaagtgattgataatcttaaaataccatacaaaaatgtgtaaacaaaaggatggtttagagttgcagggcattataaaatatgtaattttagttaagactaataataatatttttgtgcactttaaaaatggttagtgtaatcttgtaagttcaaagctgggttctcagtgagcagcaaaaggtgttagatgcatcaccacacttcacaggacctcctgaatgactgcagatgtgctgtgtaccttcttaaggggctttggctgaccttatgagagcaggagctcaccatgcttatgggtgactatatcaaaaagatctgcaataaggctcacctgggagatgctctagcattcaaattcctatactcctcttttatctacgctgtcagatgaaaactgcttactgcttttaaaagatataataaacaatataaattctgatagtaaagcactataaaaattaggtatgatatttttggcacaaagcactttttaaacccaagctcattttgcaaaatatatgtctagagtttatcatttgaaaataaaaacatatacacaatatgtaaatggttttataagtgaattaattagaatgtacattttcttaaatactgcacataccttcagcttactccagtaccagacatctgcatgcacaccccacattctacattacacagatattgcacaagtttcaatgccaaaatactaatgcagtctggcaagatttagggtttacctttcagtattattttgtgaaagtattcagattcaatactatttcgcagaaaagctacatgaccaatttcaggaaaagaatgcttgctatctttccttgatccacagtattaaaatctgtaacaatatatttaggcatttcatttatgttttccagcatttaaaattccgcaaaacctgtgtttgaaatttcttatagcattcctttacaaacaggagaagcttcgtctaatgtaaaaaaaattaaaggagtccacagggcaataatttttccaccagaggtctcactctacattctgaaaagcactgcagagcaatatttaagtctgtcactttcagagagccattaggagcaaagtctgctgaaaaccttgtaacataccatgacagctggatgggtttcttaatgcattgcacaatgtaattcaattgttttcctcccaaaacatcttagggtatgctacagctgctaaaaggatttctgtttttcttggtcctttgtttgttgggtctaagattgatgacatctccaccattgagggtacctgaattctgaccggagtgacttccaccagatgtattaaagacacctgtataaattgagggaaaagagtgattgccactgacacgcctgagttacctgttgcatccagcttgttagtaaaatcagtaatattttcaagtatttacagtttctctaaaattgtagtaaaatccaacaaaatttagcatcttaaccatttttaggcatacggttcagtggtattaaatacatttgtaatgttgtggaacaatcacccccgtccatctccataactcttttcatctttaaaactgaaactcatacccattaaacagtaactaactccccattccccctccctgcagaccttagcaaccaccattctatcttctgtctcttatgattttaactactctaccttatataaatggaataatagtgtctttttgggactgacttatttcatttagcataatgtcttcaaggttcatccaacgtagaacactgaagcatttccttcctttttaagggtgaataatattccattgtatgtatataccacattttgcttatcctttcatacatcaatggacacagatttatgattttaaagctcttgttttagttttacttttagtagctaatac

SEQ ID NO: 10785 - DNA, 164831 bp, Homo sapiens
  misc_feature (1)...(164831): n = A,T,C or G, or insertion/deletion polymorphism (see Tables 1-2)
tgaaaaggaaatcaaggtaatctctgatgagggaaaactaagagcatttgttgacagcagaccaatgcaaaagaacagctaatggaagttctcagtggaaaagaaataattttttaaaagaagaacttggagtgtcagaacaaaagaaagaacatggtaagagcaaaaatattgttaaatacaacagacttcccttctcttgagtgttctaaactatgtttgatagttgaaaaaaaaattataaaactgtccaatgtggtgttcaatatatgtaggaaaaatatttaagacaattataaatggggaaggataaaggactataaagggaggtacgggttccacacttcacttgaatttgtaaaatattgactgcagtgataaattatggggataaatcacatatacagtcatgcaccacataacaacatttcggtcaatgatggattgcatatataacagtggtcctttaaaattacaatgccatatgtttactatgccttttctgtgtttaaatatgtttagatacacaaatatttaccaatgtgttacaagtacctacagtattcaatacagtaacagcgtacaggtttgtggcttaggagcaataagctctaatagcatacagcctagatgtgtagtaggctataccatctaggtctgtgtaagtacattttagtatgttcacacaatgacaaaaccataatgtgcatccccatcattaagcaatgcatgactatatatataatgtaataccaagaacaaccactaaaacaataatacaagcaggtactctcaaaaacacacagataaatcaaaatggaattctaaaaacacaataaaatcagaatttaattgatatttatagaactgtctatacaacagcacaatatacctcctttcaagtacccagatagaacatattctgggccataaaacaaacatcaacatgtcacagggcaaaccccaaaactggagttcagcccaggaggccacgtgggtttttggctttgtgcagaaggaattcaagggtgagccgacagagtgacatgaaagcaagtttattaagaaagtaaaggaataaaagagtggctgctccatagacagagcggccctgagggctggtggttggttatttttatggttttttttttattatatgctatacaaggggtggattattcttgacttttctgggaaagggatgggggaattcccagaactgagggttcctccctgtttcagatgatataaggtaacttccagacgttgccgcggcatttataaattgtcacggtgctgatggcagtaacctttagtatgctaatgtattataattagcatataatgagcagtgaggacaaccagaggtcacttgcatgaccatcttggttttggccagcttctttactgcatcctgttttgtcagtggggatcttttaagacctgtatcttgtggaaccagatctactgacctcctgtctcaaacacacttaaaataatggaaatcatacagaatatgttcactgatcacaatggaatcaaactagaaatcaataacagaaagataaaacagggaaatctccagacagaaactaaaagcacacacttttcaaataatccaggattcaaagtagtagttacaaggaaagcaaaaaaaaaaaaaaacaaaattaactgaaagtgaaaatacatgtgaaactttgtggggcacagctaaattagtgctgaaatgggaaaatatattttattttattgttattatttttgagacaaagtctcactcagtagtccaggctggagtgcagtggcctgatctcggctcaccgcaacctccccctcccatgttcaaacaatcctgcctcagcctcccgagtaggtgggactacacgcatgcatcaccatgctgggctaatttttgtatttttagtagagacaggacttcaccatgttggccaggcagttctctaactcctggctcaagtgatccgcccgccgtggcctcccaaagtgctgggactacaggcgtgagccaccgtgcccagcctaagatacgaaaatttagagcgctaaatgcttactttgaaaaggaaaaaagtttcaactcaataatctaagcactcacctcaagaactagaagaagagcaaaataaacccaaagcaagcaaaaaaaaaggaagatactaaaaaagaagaacagaaatcaatgaaattgcaaacagaaaaactgatgaaacaaaaagctggctttttgagaagatcaataaatttaataaaactttagtgagactaacacaaaaaagagagaggatacaaatacctaataccgggaataaaataggggatagcaacatagactctgcagactcaaaaggataacgtaacaaccctacacacataaatgtgacaacccagacaaaatgaaccaaatttttgaaaagtataaacgaccataattcacccaatataatataggtccatttgaatacccctataactatgaaggaaattgaatttgtaatgtaaaaactcagaaagaaatctacaggatcaggcagtttcactgaagaatcctactaaacatttaaaaaattaacaccaatgtacacaatctcctccagaatagagacgaggaaacacttcccaactctttttatgaagccagcattatcttgataccacaaaaagacactacaaaaaagaaaattagacaaactcttctgaacaaagatgtaaaaatcttcaacaaagtattaataaattgaattcagcaatatttaaaacacaatacactgcaaccaagtggactttattctgggaatgcaaggctagttaaatactcaaaaaacaatcaatgtaatccaccatattaataaactcaaggaaaaaaacacaacatagtatcaattgatgcagaagaaatattgacaaaattcaacatttgtgagaaaactctgagcaaactagaaatagaatgggacttcttcaacctggtaaaaggcatctataggccgagcacagtggcacacatctgtaatcctagcactttgggaggccaagtcaggctgatcactgaggtcaggagttcgagaccagcctggacaacatggtgaaactgtgtctctaccaaaaatacaaaaaattaactgggtgtggggttgctcgcctgtaatcccagctactcaggagacagaggcacaagaattgcttgaacccgggaggcagaggttgcagtgagctgagatcgtgtgccactgcactccagcctgggtgacagagtgagattctgtctccaaaaaaaaaaaaaaggaaaaaaaagcatctataacataaaacaattctggaagacagactgctttcccctcacattgggaacaaggtaaggatatatattctcactactcctattcatcatacatgaagttctagtcattgtaataggaaacaaaaataaaacacagattaggaaaaaattaaaactttctctattcacaaatgacatgattatctctgtagaaaaacccatggaatccaccaaaaattcaaaaaccaaaccctgaactaatgagtttagcaaagtcagaggacatatgtacaacacacaaaattcaattgtatttctgtgtacaaacaatgtacaatttgaaaccagtattttttagaatgagatttacaatagctccaaaaacattaaatacttaggtataaatgtaacaaaacatgtacacaatctgtatgctgaaaactacaaaacactaaacaaatcaaagacctaaataaatggaaagacatatcatgttcatagattgggagactcaacaaagtaaacagcaattctccctaaattgatctacgggtgtaatacaatttcaatcaaagcaccagccaaatttttctgtatccacaagctgattctaaactttatacacaaaggtaaaagaatcagaatagctaaaacaattttgaaaaagaataaaactggaggaaattatactacctggttttaagacattataatgctaaattaacaaagtgtaatactggcaaagggaaagctaagtaaatcagtggaacaaaacaggcccaaaatagaccctcacaaataaagacaattgatttttaacaaaggtgcaaaagcaattcaatggagagaagacagtcttttcaacaaatagtgacggaacaactggacatccatatgcaaaaaagtaaaccttcacaccttatacaattaactcaaatggatcacagatctaaatggaacacttttataaaacaatttttagaaggagaaaatcttgacctgttaggcagagtttttagacatgacaccagatgacccataaaaggaaaaactgatactggacttcaccaaaattaaaaacattgctgtctgaaagacactgttagaatgaagagaaagacagactggaagaaaatacctgaaaaacacgtatctaacatataatttgtatccaaaacatataaagagccttcaaaactcaacataagaaaacagcccaatttaaaaatgggcaagagactttgccagatacctcaccaacgactccatgtggcaaatgaacacatgaaaacatgtacatctttagccattagttaaaggcacattaaaaccacaaggagataccactacacacctattagaatggctaaatttaaaaaaactgacactatcaaatgctgggagtatgtggagcaactagaactctcacatgttgcttgtgggaatgcaaaatgacacagatactccagaaaacagtttaacagttttttaaaagttaaacatacatttaccatatgaccctgcaatccactcctagcaataccctagagaaatgaaaacatgtccatgcaaaaacctgtacatggtatttatagcagattgattcataatcacagaaaactgaaaacaacctcaatgtccttccatgggcagatgttgaaacagactgtggcatatccacataataaaatagtactcagcaataaaaaaagaaattatccatacatgaaacaacttggagaaatcttaaaggcattatgctgagtgaaaaaaagctaacatcgaaagattactaactgttatgatttcatttctagaaaagattagtaattgccaggggtaaggagtatgatataatgggatcacattaggttttttttctgtggcgggggagcgatagatttgttctacatccttactgtagtggtggttacatgagtctaaaattcgcagaactgtacatcgaaaaaaaatcaattttaccatacactttttaaaataataaattaatttccttaaaataaatttaaagaaaaaagccaaattaaattttaacaggcagtcggactcttgcttttcagaaactatagacttaaagcactagatcaaaacaattacgttcctagaaataagcatacttctgagtacaattaaaaacctcgacaataatactttatataaataccctttccccaaaacttttaacattttgctaatgcggtctaataaattagagaagcaaagggtgagttaactcactaatcaaaaggttgttttctcataacagcctttatttaagtagaagtacaggttatatttgtaaaaatactgaaaaacttcttagggtcaatgaaattacctagatgttaggagatacataaaaacctagagaagttaacagcccttttcagaccctactgccacttcactagctcctgataatgaagttcttactctcacacgctctcaggttcttactcctgggaactgccgatggctcctcggatctccgagtaaagttaattctgtagcaaccagtgtcaatggaacagcacaatttggctcattcatattccagcactctatgaacaagaaactagggaagggtggggtcgcgggtaaagagtggtcgcactgcagggaggagtctaaatgccagggtggagctgaggactctcttcgccatcaaacctaacctgagcacttcacgcccttactggtgtctggcccagcccgggtcgccccttccccagtcgggacttggggcaggcaaaaagccgaacgttcggccagactggggacgcagcgccgccctcgctccacccctctttcccgcccaccaggcaattccaggtacccaccgctgggagctgggagggggcgccgggctggcgctgccgcccaccttctctagctggaacttgggatcggtgctcagggaggggagagccggcgctcggcggtccgaaccgggggatgggggagccgggccgggaggcccctgccctcgatacccctgcccactccggagagtaaggcacaacccgggaccccggggagaagctgagtcttccccagtggagccggacgaacccccagcccctggagagggcgagtgagtgcagcgccgctgcaccgcagcgcgagccgctactcaccgtcccccaccggccgcggacccgccgcccggcgccaccggctcctcctggtcgcggcgcaaccgctgccgccgctgtctcctcccgacgcgccagctctccctgcggggccgagcggctagttcgcaccctctttcgctctcttaagaatgattatgatttttaaacgaactttattagtagccagggctcagattgagtggctcagcagcagctccgccgggggtggtggggcgcgggagtctcgactcccctcatctgtggacccgccgcgctgcggagcatgcgccgtgcttcgtctgcgcatgctctgtgcggacccgcggccctgccccgcccctgttctggcgggtggctggcggcggctcagctttccaggcgcctccaagggagcccgggagggcagtggggagatcagagacgagcaggatctcctagatcgtgaactctagaaaagagaaatcggccaatgacggtccgcatgagtttcgcctacagagttatcacacttccagtgtcctcaaagggcttgccccgcttcggacacctaccttattttcttgaccagatgacatcttaagtggccaagtgagcaaaaaaatgtcgagcaaagtcgaaaacgcactcacacagcctgcaggacaaaatagaagcctgagatggttaattattcagagaagcgaaccaaaaacgaaaaggttccgcaaaagcaatctcaactttgcttcagttgtttttatatttcaaaataaaatagaatagaaaaaaaagatggaaaataccaagtgttggccaggatgtagagtaactgcattcttctactttgctgctggaatgtaaactggaacaactcctttgaaaaacagtttgggactgtctgcaaaaggtgcataccctatggccccgcagttccacgcctgcatatagagcaaagagaaacgaatacttagggtgcacggacaggcaggtatcagaatgttcgtagctgcatttattgtaataattccttaatgagaataacccaaaagaccatcaacaatagaataaattaatgaaattacacagagttcatataatgaaacactatacagcaacgcaaaaaagcatctgcaattacaggcaataacgtgaatcaactggggaaacctaatgcccagcataaaaagacaacaaaagtacacatggcataagtccatttctataaactacaaaaacagaagaactaagaggctcaaagttagcataatggttaccttggtgggcaggggatagtgactggaaggagttagcgactagaagaggggcttccagttagcaactggaagaggggcttccttctagtgaggttctctccgttgattttggcgctagttataaatgcgtgtccatttgtgaaaattcaagctgtactcttatgcacatttttctgtatgtgaattataattcacacttaataattttaaaaattagtggagattattttacctataatagcaatagtatttgtaagaaatttaatatcaagtagctaacagatttatctctaggatttggttggcagtatctcttaaacttgagtaacgtactgatgccctttctgagaaaagaaaaaaaacaattaaaaagttggcaaatgacttgaatagacatttctccaaagaaggtatacaaatggccgatgagcacatgaaaagagactcaaggtcactaatcatgagggaaatgcaactcaaaaccatgagatacaacttcacamtcattaaaatgatgattataaacaaagcagaacagaaaataaatatgagtgttggcaaggatgtggaaaaattataacctttgtgtgctgctggtgggaatgtaaaatggtacggccactatggaaaattgtatggttcatcagaacattaaaaatagaattatcgtatgattaaataattccacttctgagtatatattcaaaagaattgaaaacagggactcaaaaaaaaatttgtacaaccatgtttatagcagcattattcacaatagccaaagggtggaagcaacccaaatgtccatcaatggatgaatggatgaacaaaatgtagtatatacatgcaataaaatattattcagccttaaaaaaggagggacccaggtgtggcgaggtatccctgtaatcccagctacttaggaggctgagatgggaggatcacttgaatccaggagttcaagaccagcctgggcaaatcctgtctcaaaaataaaagagagagagggaaattctgacacatgttatagcatggatgaagcttgaagacattatgcctagtcgcaaaaggacaaatgctgtatgattcaacttatataaggtacatagagtagtcaaattcatagagacagttggggggtgggaagtggttgtgggaaaggaagggcaggtgggaatggggagttactgttttatgtctacagttctagctttgcaagatgaagaaagtctggagatagatggtggtgatggttgcacaacgatgtgaataaacttgatgctcttgaactttatacttaaaaatggctaaaaatggtaaattttatgttttatgtatatcttgccaaatttctttttaatgggaaaaaaaaaaaagaaaatcttagagggtctcagggagtacttctgggatccaaatttgagaaaaacttcctgaaagggggttcccccaaaatcatttctttcctccccacttttccatttccttgggattgttggacattgaaggagatccagaatatgccaccccaaaacatgccactttgacacaagcattatttggagttgaaggcaattaagaaacagcagaacagaagaaacactctgcttttcctatttctgcctaaaagcaggacataaatttccctttgtgaagttgttcctcctccccatcccacactaggaggaggagattcctatcaccagagcaccaacttgagtcatatggcaaaccttgcaaaataacccttgtcttccaatagtttccctcatatagtttactcggccacaatttaccaccttcacaagtcccacccctttttcctttgtcttatcacttctccacaatttatcaccttttaaaaaaatggtatataagctcttaggcctaactgctttttggggttttcacttcctttctgtgaggccccccatgtgcatatgaaataaaccttttctcctgtttatctgtcatttgtcaatttaatttgcaggcttctgctactgaacttacaagagtagagaaaaagtgtttatcctccctgcagacatgctcagtgcaattaaagtctactttttatttgacttgaggctgctctcaaggacacagcagagattctcatgctctcactgaaggcagtgaaataatgaaagcctgcatggaaacctggccttttaaatcatgtagttgtgctatagtagaaatagcaacagaattaacctaaaaggttttgaaagaaattttacctgcagtgactagaaatgagtttcacaaaattattttaaggaaaacattctgaaaagttagttattaagtcattaaatgattgtttgaatctagtacctccactgatccagcaaaaaatgtccatttgttcccttgctcgttctttcattgtgtctgactctaatgaactgaacagtgtccaaggatcatgaattgtagctgagtagaaagaaaaacagaaaaatcagaaaatattttcttccaagaaagaaagctttgaaaattttaccacttagaatataagtctgcatatacatatgaatgcatatgtggccatctggaaaaaactagtagaaatcacagtatttggctagacaataataatctactgttcttcagattcaaacagatcatgctggaaaaaaaattttttctagtactttctaggcagacattagagtactgattcagtttttctgttgcttaataaccttggatcttagtatcctcatctatagtaaggagttacccaccttacaaggtcatttatccattaaaaaaaatacatattgtgccaaggactgtgctgaacattgggtattcagtaatagacaaaaggcagatggtttgtgtcctctgggagcttataatgtgttaagggagaccaaaaaagaaagtatacaaatacacacatatgcacacatatacacaaataagtgattacatacccttagacattatgtgaaagtaaataactggtatgatggaagcatgtaagagggagccctaatttatgttggagaaccaagggaaggcctttctgatacagtgatttttaagctgttatctgaaagataaatgagtttggtraagaatagacagaaaaagcctttaagcagagacagcaggaagtacgatggcctgaggcagcaaacaattcactgggtttgaataattgaaagggagccagtgtgcaggagtgaggtggaaagcggtatgtaaaaaataaagaacagtggtgagggaagcaggggccagatcatgaagaccttgcaggtcatattaggtaatttggattatatctcaagtatattgggaagccattggaggattttttagtgcacagactaggagatccactggacagttttaaaaaattcctctgactgctatctagggaaaacatagagtagtggaaaatgggagagcaatggaaggccggttcaggcaaragatgatggagggttagactgagatggttacaggggtgatacagaaaagtgcatttgtttttaatcttggaagtagaacctataggatttggctatggtgtaggaaaaagacggaatgtaaagagtgacttgcaggtttcttgaatgactgccttgctgagattggtcactaagggactagttataacccctcacagtgtgagtcggggaataatctgttcattctaaattcctttttgttttgtccttgattgttcttgtattatggtctagtgtgttccagcatatacacttctagatttagggcccttactaacaaagaataattagaaaataaaaatcttttttttttctttactgcccaagtctttctcatatatatatttacttttgttgaaatactcttagtatactgagagacctcctctctaatggaaagggctggactagacaactctctgacttttgagaacttcgctcatggtaaataaggaaacgtctgtgtgatattcttcctcacacttctgttggaacatttgttcacctcgcttcagtgatctgatgcattttcaagagcttattcacaatcaagtttttgtcatccattccataatttaaattcttctcagtaggctgggcacagtggctcacgcctgtaatcccagcactttgggaggccaaggcaggaggatcacctgaggtcaggagttcaagaccagcctggccaacatggtgaaaccccatctctactaaaaatacaaaaattagctgggcgttgtggcgcacgcctgtaatctcagctactcaggaggctgagacatgagaattgcttgaacccgggagatggaggttgcagtgagccaagatcatgccactgaactccagcctcagccacagggtgagaccatctcaaaaaaaaaaaaaaaaaaaaagaataaataaattcttttctcagtgctctcataaaataagtagaaggactatttgattaaccttatttgtacatataaataaagtaggtaaaggtcacataccctacaggtagttttgatacaagaatccaattctcttaatgggcagttatgaattcaaactcatccacttgcccattccctggatttacaattattaagtcacaaaaaagtggtgaggaaatgttctacttgtgctaatacttgtgcatcaaatacttgatgctcatgacagaatatttttacctcttaaatataatcttttcaacattaatcagtaattgaggttttgtgcttaaagttattttgcaaccaggactaattcttaattttttaaccacttctactcaacaaatatataaaacactttaaatattgatgcatctcctggtttttggtttttatttcttgatatcttatagaagatctacaaaactagagttagaagccagaaagaagcctcagatggtgataaataaaaatgttctgtcttaatgctgattttttcagtaatgaagtggtataaactcattactttcatgaagcttcctaggtcatgaaaataacattgttgtagagcttccatgtgcatcaggtatgactgaatagtttgatgcacttgcaaatcacaaagtgccttcctttgaaatgtgtaaggcaggttgagatgcagcttctcagatggatttagtccctcctaggactagatgtctccttgttgcagctgaattctcatttcatttacccataactagaaacacctcatgaacacctattttaaacattgagttgccatcaacctgagggaccaaagaaatggattgagggcagggagtagttggaaagagcagggaattgatttaaagatgagacatgtgcgataatgaggtacaggcactttgtggggtatgggagggccccaggtagacaggagctggcatatggcttacagtcatccagccaacgttattgggctcttacaactcaggcttcggagccagaatccctatatttgaattccagctgtaccacttactagccgtgttaccttggacaagttacttaaatctctcagcgcctcagtttcctcacttgtaaaatggagataatagtagtacttcctggagttattagaggaatttaatgagttaccataygtaaaagcacttagaagagtgtaagccctcaaaagagttagtagaagtactagtagtatttgaaagttactagttatatgggaatggaagggacagaaatgtctccaaacggactcatctctaagtggtgaaatgccaatggcattgccaatgatatatctttttctcctccttgctagagtttttcttcagctttactgctctgcagtgtccaagtatggattgtttttattatatctacagtatttagtgtgctacttcaataatgtctttcttcagttctgcaaaattctcagccttatatcttcaaatattgcctctaacccattctattttctttttctggaactcctattaagagaggctgatcctaaacccctcttataattttcatatcattatctttctggctttattatgtgaaatggccgatcttccagtttaccaatttcttctccatctatttctattctacagtttaaatttacctgagtttataatctcaatgaactacatttaaaattttccacatgttctctgttttgttaaaatttcttttctcctgtagtcaaattattgtattcattaggctttttaatctttttttgcattactttaattctttttttatttatttattttttttttgagactgaatctcgctctgttgcccaggctggagtgcagtggtgcgatcttggctcactacagcctctgcctcccaggttcaagcaattctcttgccttagcctcccgrgtagctgggattacaggcacatgccaccacccatgcccagctaatttttgtatttttagtagagacagggtttcaccatgttggccaggctgatctcgaatacctgacctcgtgatccgtgcaccttggcctcccaaagtgctgggattacaggtgtgagccactgtgcctggcctgcattgctttaattcttttgaacataattattttagtccctttgctattgttccattatttccaattcttttttgttgcactcgatgactctccctcatcatgcctcctttggtggtttttaatttaggaatgtgaagtcatcttcatgagggctgccttttctatgggacttctatatgcttagcccctgtacaatggcttgatatctgcttttgatatttgcttttgtcaaagccagggcttcagaatgttcaaagatgtgggaacagcatttaaattctcagcttggaatgcccacatcacataggtagcataaattcagaaaacatgtccatccatggtgtaggttttgggccttgattcctcccagaaacatttccccattcaggatcctgggggatggtaatcttccttgtcgcttccctgttctccttgacaaaatttttctagctcccttttcactgaattggtgcgtattctagtgccttgtttttatgtctgtgtctcacttccagccttctctttcatctagaccaggacatctcttcaatcacttgggagcattcaaccttctgttttggtcctcaggtggggcactttcttggcctgtcaggaccaytggggattcccctttctttgttttgacataggctattgtattttttgttgttgttacagtttatcttagtgtatatgtttatctacgcttatcaaggctgtgcatatctagtgggagggttgatatcagttcagttagcatcgttacaggaacagggagtcttgctttattttttattgcaaattaattctgatctgagacatcacttgccaggggtcgtaagatacccaatgtcagtctttaaattaaagatttccttctcttttccatagttgcacaagacttgtcagaggcttgcacagtttggaaaacttaggcaaagaccctggtactcaattgtgatcatcactgtgatgtgaattgcccatgtacattgagtctatttgaataaatctacatcctttgtgcccagtttggttataagtatcttttacctcaactcccagggttatggaggttggtgttcatgtctccaccactgagaagctgaagcaccttcagaggctgtactgtatctcctggtaaagccaggcacagatacctgtagtttttggaacctgctacctccatcagtctctaggaaactaattacattttttcaatcctaaggatccacctcttgagcagaatggtgaggacatttgaaatgtgtaggtacattttttggttatcttaatgactagggtatactattgttatttagtgcctagaaaccagggatatccagtgaagctttccagaaagtccactggagacttttctttgagaaacattgtcttttccatccatatgtgagatggtccaacttaatcctcttggaaagaccatacttaaaaaagtttttacttttcccctagggaaggtgtaatgagctcagacctttttaaaaatacaatgttaggtttctcttcctgtggtagggaggggaaagggattactttattctacttggtaaatacttatctcaaaaactcaccttgaattacaaataatgatgcaaaaacaaattacaaactgagaaaaaaatactctcaatatatgacagataaagggctaaatttctttaatatacaaagatctcttacaagtcaataagcaacaaataggcaaaaaccactcacatccagatactgaaatgaaagataatagcctattgacatgagtatatttaatatcttcacaattcagaaaatgcaaattaaacaataaggatataattttccttgtgtctgattgacaaattgaacaggttaacatttaatatggggaaggatgtgggaaaacaaatattttgttggaacgtaaatggaattaacccttttagagagcaatttggcaaaatatatcaaaattataaatgtgtatttccatgtgtaacaattttatttacaccattttctatgagtgcttgaaaatattagtatattccaggtagaatccctaagggaaaaaaaaaacaaaccactagtacaatgaacttaattatcccaaacgctagggaaaatggatatggaatttatggtctgagcaaagcattcaatgcttttcttcttttcatcctaagttatagttggttacttccaaatataaaggctaaagctttggcattaccatgttttcagagattcagaaattcttctattaaagaagataatctgtcttgaatttcttccaaagatttctttttttcaagagacattatttaaggaagatagaatgaatgcaagacaaaacaagttccgcaaaacaaaacaagcgttccgttgttgtattaatgatggttatagacatcgagtttcagagccacgttgatgagtccagattctggtcctcaaatttgtaagtttaaaaattaaaattttagggactgggcgtggnggctcacgcctgtaatcccagcactttgggaggccgaagcaggcggatcatgaggtcaggagttcgagaccagcctgaccaatgtggtgaaaccccatctctactacaaatacaaaaaattagccaggtgtggtggcgcgtgcctgtaatcccagctgctcaggaggctgaggcaggagaatcacttgaactgaggcggaggttgcagtgagctgagatcgcgccactgcactccagcctgggtgacagagtaagactcygtcaaaaaaaataaaaataaaattaaaattttaccaagggatggttaggtaccaggaaaccaaccatctttcaagagccttatatacataaatcagaatgctaatttattaacctgtaataggatatatagcaagcatgataaccagatttaaacttgtcacaaaacaccttcyctttcttacaaatagcagactcctccttcttgcyctctccctgttcttcttccctgaatgttttctttttgttgtgcacatacagttaggacaccaaattgtaagtcagaaagttgttgggtgagcacacagttaaaacaaatggaattggatgcttttgggatggatttccagcaaactgagaagtactaaggaattgtccttccacatattagaggtatttcttcctaaaaagctggccacagatcaagaatcagaatactctttctctggctagtacaggagaaatactagcaaagatatattttctaattcttctttctctagtttccatgcaaaccatcatattcctctgtatgaaatcatgtacccacagacatgttggagtttggtcatagcctagtttgcatttatgttttaaattgatatctccagcaagaatttcagatatattcttgccttactgaacttttgtctcagggaagttttctgggatgagtttccataaatggggtaatgtcaagtattttatgttgcttctttcccattcctgaaagtaagaattatattttcatttattcatccatcatacattgagtgctgtaatttgtcaagcattatgagtgatacaaagatacataaaacattgttcctgaatatatttaatctttgggttttatctagactatgtactattttaaaaattaaactagcttttataattctaaaagttacaacttgcactggtaaaacttcaacctctacacaaaatgygtaaaatgatcactaaatgtctaccctctccgtatgcacttacctgatgcctgttccactcctaggggtaacatcttgttaacaatgtctttcctccttccctcctccccctccctccctccctccctccttccctttcctccctccctcccttccttcctccctccctccctcccttgacaggggctcactcctttgcccaagctagagtgcagttgtgccatcatagctcactgtaaccttaaacacatgggctcaagtgattcgatccttctgcttcagcctccctagtagctaggaccacaggtgcacagtactacagcacaactaatttttaaaattattattttttatacagacaggatctcacaatgttgcccaggctggactcaatctcctgggctcaagtgatcctcccgccttggcctcccaaagtattggaattacacatgtaagccgccatctctggccctctgttaacaatttcttatttattcttccagaattttagtgtgtacgaataaatagatntatgattttctgccaaatgctacatacatctatatgtgataagtaattctcaatttgaaggatagactaaatttctttcaaacacagacttagctctttagatgaaaagtcattaggcaggaatggaggtaagggctggtctaaggtctcttnggtgtctggattcactgaatttcaatgatgatacagtaaaaaaaattgtaaaagagcaaaaacaattaaaaatagatgtgtagttatatttttcttcttacatagacctaacttatgaaacacaaaagggtatctactccaagttgtgttattttcaaattttcaatactagctcatttagtattgtcattgcactagcatcactgttggtattctccagcgtgtgagatattaattaaactcctgtttagaaaagttgaagataacagctactaactgaggattattaattttatggctttaataataattttagtaacttgtgtctgctgtgttttatttttattttattttattttattttttgagatggagtctcgctttgtttcccaggctggagtgcagtggcgcaatcttggctcactgcaacctccgcctcccaggttcaagcgattctcttgcctcagcctcccaagtagctgggactacaggtgcataccaccatgcccagctaattttttgtatttttagtagagatggggtttcactgtgttagccaggatggtcttgaactcctcactttgtgacccacccgccttggcctcccaaagtgctgggattacaggtgtgagccaccatgcccagccctgatgtgttttattaattttttggaaatgactgaagtttatctgtaacaaatcggtattgattcgaaggccagtcacagtggtttatgcctgtcatctcaacgctttgaaaggctgaggccagaggatcgtcggagccaaggagtttgagaccagcctgggcaacatagccaccccatctctaaaaacaaaataaccgagtgtgatgacacatgctacttgggaggctgaggtgggagggtcacttaagccctggaggtcaaggctgcagtgaagaatgatagtgccattgtactccagcctgggtgacagaatgagacccttctcaaaaacaaaacaaaacaaaaacaaagtgaaataccaggcacggtggctcatggctgtaatccccgcactttcggaggccaaggcaagcagatcacgtgagatcaggagctcaagaccagcctggccaacatggtgaagccccatctctactaaaaatgcaaaaaattagccaggtttgctggcacatgcctgtaattccagctactcaggaggctgaggcaggagaatcacttgaacccaggagggggagattgcagtgagctgagatcgcgccactgcgctccagcctgggcaacaagagcaaaactccatttcaaaaaaaaaaaaatgaaaaaaatgyttaaatgtaggactggattaatgaaattcaaagacacttgtgcttcatgcaaacatagtgtcactttagcatctgtgataggcaagataatgccccaatctcttctaccaccccaaagttgtccacatcttatccttgaaacctgtgattatgtatgtaccttgcatggcaaaaaggactttgcagatgtggttaagaattgtgagatggggagattgtgctggattatccaagtgggcccagtgcaagcataaggagtctttataagagggaagcangagggtcagagccaaaaaagtagatgtgacacagaagcagaggtcagaaagaggggtggagaagagagagagatttgaagatgttgtgctgctggctttcaagatggagaagggggctacaagtcaaggaatgcaagtggcctccagaagttggaagagccaagcacaaggattctcctctagagcctccagaaagaaccaaccctacttccactttgattttagcccagagagactgattttggacttctgacctctagaatgaaaaagtaattaatttgtgttgtcttagagcactacgtttgtagtaatagttatagcaacaataggagactatatcgtaagctgaatttagtatgtctcctactataaaatctacctttttccttgcttcactgacttggtgagtccacctaattctgatgcctaaagtcagatacctgggagtcattcttgacactactgtcaccattcatgtccaaatctgacctgtcattcttccttccctgtagctcactggtccatgttctcttcactcacctagacaagtgtgtaatagcttcccaattcattattattattattattatttgcctctagcctccaccttttattcattctacactttgttcccagaatgatctttttttttctttttattattattatactttaagttctagggtacatgtgcacaacgtgcaggtttgttacatatgtatacatgtgccatgttagtgtgctgcacccattaactcgtcatttacattaggtatatctcctaatgctatccctcccctctccccccaccccacaacaggccctggtgtgtgatgttccccttcctgtgtccaggtgttctcattgttcaattcccacctatgagtgagaacatgcggtgtttggttttttgtccttgtgatagtttgctgagaatgatggtttccagcttcatccatgtctctacaaaggacatgaactcatccttttttatggctgcatagttttccatgttgtatatgtgccacattttcttaatccagtctatcattgatggacatttgggttggttccaagtctttgctattgtgaatagtgccgcaatgaacatacttgtgcatgtgtccttataacagcatgatttataatcctttgggtaaataccagtaatgggatggctgggtcaaaaggtatttctagttctagatccttgaggaatcgccacactatcttccacaatggttgaactagtttacastcccaccaasagtgtaaaagtgttcctatttctccacatcctctccagcacctgttgtttcctgactttttaatgatygccattctaactggtgtgagatagtatctcattgtggttttgatttgcatttctctgatggccagtgatgatgagcattttytcatgtgtctgttggctgcataaatgtcttcttttgagaagtgtctgttcatatcctttgcccacttcttgatgtggttctttgtttttttcttgtaaatttgtttgagttcattgtagattctggatattagccctttgtcagatgggtagattgcaaaaattttctcccattctgtgggttgcctgttcactctgatggtagtttcttttgctgtgcagaagctctttagtttaattagatcccatttttcaattttggcttttgttgccattgcttttggtgttttagacgtgaagtccttgaccatgcctatgtcctgaatggtattgcctaggttttcttctagggtttttatggttttaggtctaacatgtaagtctttaatccacyttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgcagatgtgtggtattatttctgagggctctgttctgttccattggtctatatctctgtttttgtaccagtaccatgctgttttggttactatagccttgtggtatagtttgaaatcaggtagcgtgatgcctccagctttgttcttttggcttaggattgacttggcgatgcaggctcttttttctttccatatgaactttggacagactttaaaccaatgacgatcaaaagagacaaagaaggccattacataatggtaaagggatcaattcaacaagaagagctgactatcctaaatatacatgcacccaatacagcagcacccagattcataaagcaagtccttagagacctacaaagagacttagactcccacacaataatcatgggagactttaacaccccactgtcaacattagacagatcaacgagacagaaagttaacaaggatatccaggaatggaactcagctctgcaccaagcagacctaatagacatctacagaactctccaccccaaatcaacagaatatacattcttctcagcaccacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaacctctcaactacatggaaactgaacaacctgctcctgaatgactactgggtatataatgaaatgaaggcagaaataaagatattctttgaaaccaaagagaacaaagacacaacatactagaatttctgggacacatttaaagcagtgtgtacagggaaatttatagcactaaatgcccacaagagaaagcaggaaagatctaaaatggacaacctaacatcacagttagaagaactggagaagcaagagcaaatacattcaaaagctagcagaaggcaagaaataactaagatcagagcagaactgaaagagatagagacacaaaaaacccttcaaaaaatcaatgaatccaggagctggttttttgaaaagatcaacaaaattgagagaccgctagcaagactaataaagcagaatgatatttctaaattttctgcttaacagccttgaataactcttctttgacatattattgtcaagctccttagtatgaccttgcctttgtcgtgctgtctagtcacacgtctctctatatcccacaatgtattccctgtttttcttttttmtttttttattttttttttattttgagacaaggtctcactctgtcgtccaggctggagtacagtggcatgatctcagcccactgcaacttctgcctcctgagttcaagcgattctcctgcctccacattctgagtagctgggactacaggcrygcaccaccatacccggctaatttttgtatttttagtagagatggggtttcaccatgttggccagactggtctcgaactcctgacctcaggtgatcagcctgacttggcctcccaaagtgctaggattacaggtgtgagccaccatggctggcrtgttcctcttattctgctacattgaatttgttatagttcccaatacgtatcatgctatttaatgtctctgtacctttgaaaatgctgttttctttcctggcatttttttctcctctccttctagttttaccacttcttttatattttgtaagaatttgtttaggccatgtgtagtgaygcatgcctataatttcagcactttgggaggcaaagggggatggatcacttgagttcaggaattggagaccagcctgggcaacatggcgagaccccaaatcccatctctacaaaaaatacaaaaattagcagggtgtggtggcgcatgcctgtattctcagctactcgggaggctcaggttgggggaggatcacctgagcctggggaggtcgaggctgcattgagccaagattgcgccacttcactccagcctgagcgacagagcaaaaccttgtctccaaaaaaatttgtttaaatgccaccatccacaaggagccctcccttaagtgccttcccctgttttcttctagtgccatgattatatttatatcatactgcttcttaatctgcaatgtgaattttgggctgcttcaaataactaatatttttgagcacctacaatgttatgcaccatgctaactctaactcataaaatagtaatcaaaaaagacatagttcttgccctcatacagctcagagactgtagggaggacagatattaagaacataattataagtactccaaagaagagatataaattatatataggtattagcaggaggatctaggggatcaataatctgtttttttttttttttttttttttttgagacggagttttgctcttgttgcccaggctggagtgcaatggcgcgatctcggctcacactgcaacctctgcctcccgggttcaagcgattctcctgcctcagcctctcaagtagctgggattacaggcatgcgccaaccgcgcccagctaaatttgtatttttagtagagatgggcttctctatgttggttaggctggtctcaaactcctgacctcaggtgatcctcctgcctcggcctcccaaagtgctgggactacaggtgtgagccaccacgcctggccagggtcaagaatctttaggctcagacatttctgtctccccagtagaccacgagcagcttgcattcagggaggagactatgttggtcctaatgggaagctacgggggaagataaaatgaaagagtacacaaagaaagaggaatactcaggacccaggaaacaggagaccagcacaggtgagaggtagagagaagtcccaggacagcagctgtgtgtgacagagaaagccacaagtcctgattggtagaagaggtagaagactcctgaatggctgtctccaaggagagataattgatagaatacataacatgtttgaaaaacatgttgagtaaagacttacatttctagaatacagtatacggtaaattaatataagatagaaaactaagcaaataacaaaaataytaagctgcgcacagtggctcacacctgtaatctcaacactttgggaggttgaggcaggaggatcacttcaacccagaagttcaagccagcttgggcaacacagcaagacctcatctctactaaaaatagaaaaataaggcggggctcagtgactcaagcctgtaatcccagcactctgggaggctgaggtgggcagatcacgaggtcaggagatcgagaccatcctggctaacacgggtgaaactctgtctctactaaaaatacaaaaaattagctggcatggtggtgggcacctgtagtcccagctactcgggaggctgaggcaggagaatggcgtgaacccaggaggcggagcttgcagtgagccgagattgcgccagtgcactccatcctgggcgacagagcgagactctgtctcaaaaaaaaaaaaaaagaaaaaaagaaaaaagaaaaattagctgaatgtggttgcacgcacttgttgtctcagctactcaggaggctgagactggaggatcacttgagcctaggagtttgagattacagtgagctatgatcacatcactgcactccagcctggatgrcagagtgagaccctgttttaaaaaayaaaaaataaaaaaagcagattctcctcttcatgataggaagttgatagatgtgtaaaactgaaaactttttcaggaaactgctgaaggaatggcaagcagaaaaaaaaaaaactttaaaaaatagcagtattagcaaggatagaaatggctgtaaataccaaaagaaaccgaaaaaagtgttgaaagtctttggaaacaagaattggggggakggggaggagtatggaattactagattactgttttaatactaaactatgcagaactatgtattttttttttttttttttgagatggagtcttgctgagtgcagtggcacgatctcggctcactgcaagctctgcctcccgggttcacgccattctcctgcctcaacctcccaagtagctgggactacaggcgcccgccaccacgcctggctaattttttgtatttttagtagagatggggtttcaccatgttagccaggatggtctcgatctcctgacctcgtgatcygccctccttggcctcccaaagtgctgagattacaggcgtcagccactgtgcccggccagaaccatttaattttttaaactatgaatatgtaaatagataaagacattacattaaaattttctgtgtcaactgtaaagtgactgataaaggctcactattattaataatattaacaataataagttgtttcttcagttagtttcgtacaatgttctggtacaaggtaatgagatcacacatcaatatctggaacacagcttggcatacagtaaatgctcagtaaataattctttctttcttccagtatctttaaataaaaatacctaaaaacttccttcatgttaaaacacattaaaagcaataaagcattaaaaatttcctgccaataaaatgtagatttacatttattttgtgtttgaaaattgcttttaaataaataaaacagaaaacagtgagccattttgatttttttaatctactaacaatgttttgtgagggaattattgtaatttaaattaggttatttttaagaacaataatttaatactaaaaaattatgttttgtggctaaaaaatggaaataaaataacttacaattgacttaaattgcrtcatgtttttccaaaccaatatgatggttaccaaatcagaaggaaaaacatgttaatcatagtgtaagcttttttcctaatatggtataaacaattttaaagttcttactgtatgacgtctcagggtgtgtatttacttaactctcagaggaagattagtaacatatcatgtgcctctttttctctttttttaaaccagtgttgctatctgggctttatttggagccttgaaaagtccaggctccttacattataattaggcaatgatgtaatctgatctggatttgtatctgaggtaatcacaggcagtttcacagtgatgtttgccttgagttttgtgcttcaggagtaaattttcatggaaaagaagaattttctagaaattctgttttaaatatcttttgtgaatttcacagatgttctcaaacaatgtagtattacttgttccataaacccatgttctccaattcgatatcaactatcaatatcatctaccaaggtcagccacctatgaaggataagtggttcttagaaggttcctaatgttcaatctgctctcatttgcaatctataattcttcattcacatcttcacacattctgaatgttaatattgcatagcctcttagaatgcaaatggcaaaaacatacaaatgatgatggtcattcactacctaaccctttcccctcaataactgcctggtatcaggaaaagggagctttaatggggaaagaagaaggataaggagtgtttgtgtgctactgatggttggtggctattgaaagcctgagttcagaatgggaggctgtgtacatatgagaaagggggaagaaagatgaggaaaggaatgatgttggtccctaagataaagattaagagggtatgttaattggaatattgggacagatgagaaggttaaatcctgttttatttatttacttgtttgcttatttatttatttgagayggagcctcggtatgttgcccaggctggagtgcagtggtgcgatctcagctcactgcaacctccgcctgccgggttcaaatgattctcctgcctcagcctcccaagtagccgagactacaggtgcacaccactacgccccgactcttttttttatttttatttttagtagagatggggcttcaccgtgttggccaggctggtctcgaattctgacttcaggtgatcatcccgcctcggcctcccgaagtgctgggattacaggtgtgggccacagcgcctggccaggatttagtttttcatacaaatctgtttcaaagattcttccaacatttcctgtaagttgccgaggttgtgggagaacctgaaagtagcttctgacttctatgtaattcaaagggcctaattatgcattctatgctgtagctttaattatacctgttaaagtatacccctggctgacagatagaatggactcctcatggctgaggtgctcaaaaacagaactatgcagccatagctggacgaggaagcagtcacatattctgttctcagaaagatgtagaagtatcactggatctccctttctgcaatcaagcctgtgacgtctgagtttgggcttggraaacgaccaatcagagctcacctaccgcagccaatcagaaaccagccatattgaccgatcagaacttagctgcaccaaccaatcagaactaagcaagtttgaatcctttatttgccggaagctgggcaggaacttgaaccctctctttgtttaacgaaatgcaccttcattttgcaccaaaggctgtatctcccagtttgcaaactgttcactggaataaagtctctttcttccaaattccttttcagagaacttttgttcacataagaaaaaattaattttaaaattgtcttcctcattaaaaattggttcagctaaggctttatatgaaaatagtgttcttttccattgaatacaattttgttggctgggcgcggtggcttacacctgtaatcctagcactttgggaggccagggcaggtggatcacctgaagtcgggagttcgagaccagyctgaacaacatggattaaaccccgtgtccactaaaaatacaaaattagctgggcgtggtggcgcatgcctgtaatcccagctactccggaggctgaggcaggagaatcgcttgaacccgagtggcaggggttgaggtgagcccagcctgggtgataagagcgaaactccatctcaaaaaaaaaaaaaattgcttaatttctgttttcatgcctgtgggtatttgccctgcaacactgcagcagttttcaaaaccaaagtttctgaactccttgaggaattctaaaaactccctgaaacgttttattgccatgtctctatgcttttatttcgtattaattatggaacacgtttgctaagtcacttcctgagcataggcagctcctctcactctgctcaggtcagtgagttagttgatatgtgtgcagatgcctcaggtacaggctgcagggatggctcccggcagggaagaactgcccttcctccacgagtcccagcactgccctacattgaggccttcctctctccactgtttctgctgctgcatttgcccccaccagtctaggcttaggtgcaggcctacccaccttggagccctatggtgcccaggatggtcccaaggcatgttaccaggccaggtcaccaggatgccgggttgcttgatgacttccatgctgctgttgagcatgctccatcgtcctatcatattaagctaaaaacacaagatcaaagataaaattgttaattattccaagatagtgtaggtctttctgagtgcaaggctgtgcatgaagctcatacacccatgatgcatcacctgcctacctcttacatgctttatgggttagttatatttgccatcactggaggtgccagtaaactcgcaaggtagcctttgtgtgaggtttggtaaccaaattgccaagttagctcagggaactgcaactcatgtccacctttcatccacttaggccttgctgtcttccctctttcaggtttcagttttgtagattttgagcctagattctctttctccatctcttagagcacaacctaagatagcattttgatagtctaagctcctggtctggtgtaactgcttccactcagaaatacttcctcttctctggaaaggaagggatcaaacaatagctcagtaagaacataattatcagatcaggagtgcctgcagatgtaaaggttctgatgccagaatatggaggtggagggagtggtcttgggatagtgcaggggatggggtttggggcatgagagtgcacttggattacctgattataaatggcagcacaatgaatttttaatataaagttacagctttaaaattattgagaaagattagttgattggtgtcactctagtcatagaaaacatacaaatctaattctgattttgtgccaacagactattatttttgtgcttgcacacttattgtatcacatgcatctctatccatccatttatccacatatctacaaatcatatatctcaacactgtaaaaaactccagttccttataaattactattttattttctcttattctaagcttccttcctgtaacttatttaattgttaacaaaatgtgttatagaaacctgtgttacttgttctgcagcccatttacgggggagaagatattatgtttccttggtctatgtttcaaaggtatcaactctctttgttcctgtataactacttacatttgaagtgaaaaactcccagaggccaacagaaaatggctatgaaactagaaagaatactattctacctacgctagtatataagtttcctaagatgttagtgaaatacagctggagaagtgcttcagtttggctcagttttgttttggcccaactcttaccaatagctcctctccaatctccaggagatacgccgtcctatcggtgatgggggaggagcaggagtgaaagacaggatggtgttgcaacaattcaaaaccccagagcgcacagttacccccaatgcactaatcagggtgtaggtactataacttactaagcctgtttaataaatccatgcctgtactcaggtgaatggggaatggtgagagaagagagaacactgtgataaccaaccagctcgaacagggaggggcagccagcccaccgttgcaaggagagctgggcagatgtctatcaagataaccatttctgctgcctgctgattctctcacctgccagtttctgcatctgcccatagagtactcatgtgctccttcctgtaccagatgatctccctggacttaatttctttttttttttttttgagacggagtctcactctgtcgcccaggctagagtgcggtggcgcgatctcagctcactgcaagctccgcctcctgggttcacgctattctcctgcctcagcctcccgagtagctgggactacaggtacccaccaccatgcccggctaattttttgtatttttagtagagacggggtttcaccgtgttagccaggatggtcttgatctcctgacctcgtgatccgcccgccttggccttccaaagtgctaggattacaggcgtgagccacaccgcgcccggcctggacttgatttcttgattgcctgcacctagagtatccatcgtctttcctacgtggctgggcaactaggtttatccctttcaggctagccctccttcattgccataacatctaggggtgacattgactgagttgtatatgattattcatcatttctcgggcctagatagattgtratgagttttagggcttgtcaaatttcaaggctctgtttttataccacacataattttgggaatttgtaaagtgcttaataattatccatcaatgagtaagctttgaaggaagattaaaaagtattatgaaataaattacagagttatagttgaggcttattcagagcaaaattatttttggtgtattttgagcactaggtaaatgtcaaaggcacccatgagaaatagcaaaaactgctgtaatagtataaattctcatttatagctgctgcagaagagatgcaaatgttctctatgtggttgctctgtgtgaggaggtgtttcatgggactatcaaaatcctatcttargttgtcattttggacactaaaaattttcaagtaataatttaaagaatcttgaggtttccttttgatatggcctagaaacctttggcaactaatttctgtatgactcaaaggatttcccctagaagggaatcctactatttgggcttttaaaaataaactgtcattctggatacatttgtagccctgactagtgggtgagcatgagtttcattctgaaatccagaaagaataatgagactaaaaaaaatcaagacactgagtacagtatattagttaatatagcatataattcaatgtttgctttagaattttgaatttagccaaaaaataattggatcaggtactaatgatcaaaatgagatcacgtgaggaattaaggagtgtacataagatcttggattacatgttacatagtcatgtggcgtaaccaaatgtatccaagtgtatttacatgtgactttgaattataatggcagagagttggtcaaggaagaagagtacccaggcacccagcaagttaacactggaaacagatggtaggagcggtttcaaattgagccaacttatttaaattacaaagagatcttcaagttcattttgctatccatagaaagcaataaatcacacctattaacttacctaattgtctttagctagcaatattagattcagtctcatactcctttaactttcatttaatagtgttattggttgagggtgggttgttgtccaggttcttggtgtttcgaacaaataattgaacaaaatgcacaaacaaagcaaggcagcaaaagcagagattcattttaaaccaaagtacactctaaagggtgggagtgggattgagcaactggcttaagagcataggtaacagaattttctggggtttaaataccctctagaggtttcccattggtttattctatgcaaatgaagtagtggcccactaccagtctgattggttgttggaggggaccaatcagaatgaagagtaggcctgcaaccagtctgatccattgcaggaggggaccagtcagaggtagtttcatttttcaacttcccctcggaaaaaggaggggctgaaaagggagtagcctctgatatccagtcagcatgaatgagccttaggctccctgcctccagaccctattctcctgcctcaatagcagtttgagataaaatgcaatgtttgaaagctaccttacagtgagttagtgatttccgtttaatatccttaatgtattacttcaaaataacagaatttattgaacaacacacaagtcaatttgcttattagcacattgttctctgcagaactgctggcgacctcattgcycnactttggaaaccacgttaatatactggggaaacagatttagttagctttgaaccatgatcacaggacaattatgaaaacatgcaaatttgaaaggctagactctgacaccacaaatttttaaaataattctccaaaaacatttgcatctaggatgtgacatgcttaaggagtgaaaatctaaactagcttttcctttccttccctgcttctgcaaaaagcatattttccccttcacatttgctgagcaatttttctttattatgcatattaggtcagttgtggaagaaagaagtctttttctagtaggattacttgtttcaaagcttagactagcttagattgagggtaagaatagcatagaactgtccagtctgagtagggccaagtttgccaagaggggttataggttatctaatgtgacataaagaatacccaggttaggttgggcgtggtggctcatgcctgtaatcccagcactttgggaggctgaggcaggtggatcgcttgaagtcaggagttcaaggccagcctgaccaacatggtgaaaccccttctctactaaaaatacaaaaattagcctggcgtggtggtgcgtgcctgtaatcccagctactcaggaggctgaggcaggagaatcgcttgaacccaagaggaggaggttgcagtgagctgagaccatgccattgcactccagcctgggtaacaagagtgaaactgcgtctcacaaacaaacaaacaaaaaaagaatacctatgctaacgtgctggtcaaaggcttggagctacaaataggatggagactggagatggcacactgagtttaaggacctagacctgagggaagaatttaaatggaatattgtgactgcaaggtggggtgttggctctgtcatgagcctgacacccatggcattactacaccctgcctgaactagttcttggccttcctgctgttgggaggaccagtatctaaatgtgtatcttcctgtgttagtgcaagttccactgtggcttagattgttcatctggtggtttggagcacacatcctgagagatgaacgaatggaacaattgttagtttattgacctagtcctgtgtgcctggacactgcaccagacaattgatataccttgactggtttttcattccctaagtctttaattatttggttttacaaatattgctatttcttcaatatgtgaacactgattcagacaatatgtgtcatttttctagtgcttcagatttgaaatctgggagtttattcattcacttactcagcaaatatgtattaggtatttactagtgtcaggtactgtgctgggcattgggtataaaaagtaaaataaaagaaacatgaccactatcctcatgatacttataatccaagggaaaaaattgacttcaaataaacaaatgcctacatagatatagatatataagattacaaattaagcagtaatttataataaatactgtgaaagaaaaatcggggggtatgaaaaacatgatgacgtaatttagattgaggagtcaaggaagacaactttctgaaagtgacatttgtgcagagacctcagaataggcaacagttagttagccgtatgaaaacaaggagtaaaataattgcagacagaaggaagggcatgagtaaatatcctgaggtgggagatggctcagtgggttcaagatactgaaagcaactggaacttggtgggcgagcaaaaagtggtaaaagatgaagtagtatttgactctttcccgttttcactcatcacatcaaattacaggttgagcatcccaaatcttaaaaccccaaatcctaaatgctccaaaattaaaaactttttgagcactgatatgacatccaaaggaaatgctcactgcagcatgtcaaattttgggtttttagatttgtgattctcaactgatanaacgcaaatattccaaaatctgaaaaaaatcataaatctgaaacacttcttgtcccaagcatttcaaatgaaggatactcaacctgtagttgtttttatttctctcttataatcttcctcccagccatgtcttcttttctgtttctttcctacccccaaactcaggctcctattacattgaagctaaatttctgtgtcagatttgtaactgagttatctgcctccatttcgtttctctccttgatccatttacagatcatatagacaagatttttaaaaaaatcatacttttatcaataaatctaaagttcaaagagatatttaggggagacatatagtctaacttactgtattagttgaggtaggtgaaccgcagttacaaacaactcccaaatctcagtggcctaccacaataaaggttcatttcttgctgtgtccgtctaatgcaggttggcagggatgttctctgcctgtgcagtcatttggtggctcatgtctcttccatttagtgggtcagtcatcccctaggtttttgactcttctgttgaatcagtctcaaatttctagaagacaaaatctgactacctagcttggatcagatgatttcctttggttctattaactgacatgggggaagggtaagttatgtacatcaaacatgggtgcagtagtcattcttgtgggttggggccatttatacagaaggggaaatgagctgggcagatcccatcaaaagatgtgttattcaggcagacatttttacttcatatattagatctttatatatttgaagaaaatcatccagtcttcttatttcccacaagctttattattttctcatgagaatgcatatttccgctttcttaggggcaacatccaggttattacagtagcttatcaactttcctaaaattcagctgtaaacttccttccaatttcacctgttgggtgaattaactacactcttaattaattattctcaagttctgaattcctgcatggcttgattcaatcaatcaagcaacctttaaccttgcttgtacagttgcctagcattaattttcagcttttcaaactccatatcttgccccattgaagatgaagaccatgtcttatttgccctttgaattaatcacaatataatgctgactgtattccttccttaattgtattcaaaaacttaataatctctccttcctcaggaatactttcatgtttacagaaggaaatcttcatttatctcttgattctgtgataagcattgtccttaattggtctacagaatgtgtcatttactctcaagaaatgcagactccaagttaccatgtattgaggctcgctatgtactgggaactctgttatgcaattttatacgcattatttaatcccacaacaagcctatgagatagttactattattatttccaagatcacacagctaatctaattctggaactttagtctcttgagtttccaagctcttgccttctttttcttttttttttgagacgcagtctcgctttgtcgccgaggctggagtgcagtggcgcaatcttggctcaccgcaacctctgcctcccgggttcaagggattctcctgcctcagcctccaaagtagttgggattacaggcacacgccaccatgtctggctattttttgtgtttttagtggagacggggttttgccatgttggccaggctgatctcgaactcctgacctcaggtgggctgcctgcctcggcctcccaaagtgctgggattacaggcatgagccactgtgcccggccttgctcttgccttcttaattgcaactctgtactgacatgcatgttaataaattggccaaactggcattctcactgcagctctgttsttttccaatccttgaacctctcattatggatgcctcatctcatcctgttgccttttccactgtgggttgtattgatcagaaagcagatctgtttatggaaggaaagaaaggtattgggtttagtagttattagaaatagaaatattagaataaagacaacattgaaagaaacagacaagagaaagaggatgaggttccccatgtttacattcctgtgactcaagagtgcagagagccaagaacaaagctgaagtttagccagggaaaggagagtgttcaactaaaattaactctgtaggcagcattcccagttgtttgagtttcaggatcccctcctcaatttcctaagaaaaacaacatgcaagttaaaaaaaaaaataaacagtagttaggggcaaagaaaccggtgtaattagggctaaagtgatctgtggtatctctaaatggtagctccatttagagaatgatctcagaggcagttttggaagggtttggatcagagcaaggaggagatcatgagtgcaagactataaactatggtctataaatcagaaagtttatactaaattcagaaactttaatgcttcttggggactgtgggcttgttaatatgctactggcctgattttggttaagtctaaggataaactggaaaatcattagtccatgtggctatatctgttctacctggtactgtagttgtgcagagggctgctcccacccttcagcactgagatcatggagctcgttctcttggtggttttcatgattgaacctggattaatagttactaattatatatatgtataactatcaatagtgtaatcatggttattatgaaatattgatataattattaatgcaactaactactctccctatattctctggtctctagtttctatcaaggaagactgagcccacacaaaggcttaggataggaggagaatcaacattcagggctgcctctgaaacccttgtgctattgtaaacagattcctctattcctccagagaaagttggaaagtggaaaagttgccttttgcttcttagccttaatgctccttctagtttttggctttaattgaaatcccagtctcacaggttaccaaagacattgttgtcatgatgttgtggtgatgatgatgggtaggtggtgagctgttgctcagctgtctgcactacaacttctaaaccaagaattgtccaactttagtgaacatcatcatttggagggcttctgaaaacacagatttctgagctccatcctcatttctgattcagtgggtttggggtagagcctagaatttcatttctaacaagttcctaggtgacattcatgctgctggcctggcaactacactttgagaatcattgttctacctcattactgattaaaatgctcaacttcctttgcaacccttggcaataacctataccatgcactctccaactaacagcccagtcgccacatatatacacttttggaagatattatggcaacaagtccactgtttcctttgctactccaacttctctataaccctaacttccactatttccaattctcacacttcctcaccacaacttcacctactctttgagcacaaggacagttttgtggcaggccgggtctcactaacacaggcctctgtaacaactgtttcagcactgacggagtggccaagttaaatattaaaagctgatcgagctagtgcccttatacaaaggctggaatgtaacaaaagcccaccaggagttttgctcaggcctttcctgggccttgaagtgtgacaagataacaaatgaattcttaacagaggcctgtttaggattaaacaagttttattggaggtctgaagaaactccccagacctccacaaacaagtttattggggggtctgaagaaactccccaaacctccatgatttagcaggagacaagataagggtaatcacccagcacctggacccattaggattaagtaaatttacsgaggctccagaggaaggtcttcaggattcagatcttagttatagattagaagaagttaatcacttatgtcttcagatgaatgcacactaacacacagacatatagcttagaaggtatataagctctggaaaactttgtaactttgagttggcctggcgatattttccaggccttttccctgtacccagttacagaaataaactgtcttctttcccagttcgtctgcntctcattattgggctgcgagaataggcagcctgaccctcagcttggtccggaaacagtttggtcacctcaattcctttatttaattcaccttttgatctcttcttggcttctaggccttctccatactgccgaggatccatagttgattattagaattactctccattgggccgggtgtggtggtgcacacctgtaatcccagcactctgggaggccgaggcrggcggatcacgaggtcaggagatcaagaccatcctggctaacacagtgaaaccctgtctctactaaaaatacaaaaaattagccaggcatggtggcgggcacctgtagtcccagctactcgggaggctgatgcaggagaatggcgtgaacccgggaggcagagcttgcagtgagctgagatcccgccactgcactccagcctgggcaacagagcaggactctatctcaaaaaaaaaaaaaaaaagaattactctcaatttacttgcatccctatatttccatcctatttccaatgatcaatgttaggtcattgccacaacctgccttctccatttttacactggttggggagggagtgataaagttgataagaatgtaaacacaaataaccacaatatacagcaatgtcccatttaaatcataagcataatacagaaattcgtgaacttgtaaaggcaggaaagagaacatctagttagaatgatcataaaaaaacttcaaggctattatggcagatacaaatatgaataagacactactagacttttttaagcccttaagtataggaatggcataatttatattcatttcactgatagcaccaagcgcttttcaaaagagaattaatgaattatgtctcctctagtgtgattctttatctattacacagtgcagtgtgaaatgccctaagggggcttaaatgctgagtaaacaaatttttaaaagcaatttagacacgcacacacacacacatacacacacacacacacacrcacacattagatgtacaagcatagaaaagtcttggaaggataaatactgtcttgctttatccatcagcatactgattacagttgtgatgaggtaagtacccacaccttttgtaatgtaaaattgtgcagcaaaacagcaaaaataaaatattacttgggggaaaaagacaattaacttgtttttggccaaaggtgatagaaacaataatacttgcatttcctgaggccctaccatatgtcaggcatatgccaccttatttacccctcaccatcaccctacagggctatattatgtattatcttcattttgcaattgggaatagttattgtatttcttccattataagatcaaatttaaaaatactttaaatcattggaatgtgtatgcatgttatcatttatggtgtcttagacttgataaaataacgtaagtcacattattataaatcattagatataatattctaacttatggtttaattggctctaaattctgtgcttttcctccattggattgcgttatcttttctaacaaaagtagacttttgctccttctccaagttttctttctctctttctctttctcttmcacacacacacacacacacacacacacacatgccatgcaggcacacacacacagtttttcctttctctttctctcactttcacacacacacacacacacacacacacacatacactcttacatcttagtccaaagtaaaaatatcctgcttatcagatgctctgccttattttcaaggcttatgcttattttgagtgtagccatggtgaacttcatctatctaactgatgtgctagtctagtctcctacctactgctaaattactcaattaacctattttgttcaattccattttagccacaaccctttagtttcagttgccttgacattggggaaaaaaaccctaatctttcttatctatttggttaattggccaaattaattctgacagatatcacataggtatttttgtttttcttggggcagctagccaccctgggccagtgcttctcaatctgggcacacaagaaacaactggtgtatcttcttgaagcaagagttctccttgaagatttacttgaagagaaagtkgaagcaggacactgaaaaatgtagatgaaaatctttgaaagaagtattttttatcttaaaagaaaaaagaaaatattatgaaacagaataaaatatctgtaggcattttttttttttttttgtgagatggagtcttgctcttgttgcccaggctggagtgcaatggcgcaatctcggctcaccgcaacctccacctgctggattcaagcgattctcctgcctcaggctcctgaatagctgggattacaggcacccaccaccaagcccggctaattttgtatttttagtagagacaggatttctccatgttggtcaggctggtcttgaactcccgacctcaggtgatctgcccgcctcggcctcccaaagtgctgggattacaggcgtgagccatcgcgcccagactgtaggcatttttaaggcacaactttaatggaattttgaactggtggtaaactactcatggtaacctgtggttgaaaccataggctttggggcaagacygaaacctagctcctcccttttctaactgtaccctggggcaagttgcttagcctttttgtgtctccatttctcatttgtaaaatgggaataatatcatctgcctcatagagttatcatgagaattaagtgaccagtatatgttaaatgttggaacagtggrtcgttcatagtgaattctccctaatgttagctattttcattttcatttatatttctagatatcccaagggttattattttgtcctcctcttttgttaagttgtctcagagcaaaagtttgagcagccctgccttagtccttccccaggattctctccagtatgctgcacttggttctcatcggctggtcttttgtaatgtttcaggaatgcactgttttcctttttctcttctctgtctcttttttttccagcaccattaaaaacaaagagtagctgttttaggaatttgggaagtgaagaaacaagacattcgactgtgagtttcacccatgtttaaaacgaaataacctaacaatcgggagtggcgtgctaccgttaagattttggaggtagagacgtgaagattttcagtcgcaactccctttagaaccatggcttgaacccgtaaagtatgagggctgcccataaaactttctcttctaagatgtgggatatgtgtagtctcatctagttatggctcatctgggaatggattttctgacgcaaatgaggtttaaaaaaaaaaggcatagtgtctctttatttggttaacactatttctgcactttgtttttccttgtcagctttaaaaggaagagaacaaaagccaaccaccctgccaaaacttggcagtagaatttcagtgagtgaaaattctccacctacagtaatgtttgaagtggttgcacagtgagggccccccagcccccaccccaacccacccacccctccactgcaggccattcttgacctgttaggacaccatcttatgcaaagttaagaaagcccaagagcctagaacccacagaaaaaggccagtgtaagactaagggcatctatcccctgttcttttttccctgttccatctgatattatctttggctcaatagtcctagaactcagaaggctgatactccaatgtaccctagaattgctagactcaactctaccatctcctccgctcccagaacctggactcttggagggcagacagcaggataggagcagcctcaaggacgggaaagcaatggagactgacctatcctttgctatttccctttgccaccaatatcttctagttataggatttttgcacctagaaataaaatatacaaatattgaccataacttacagtaattcagtgcttctaagttcccatgtaccatggcaaacacatggatatattatagcaacatcataaaacagacatgattatttctataccaaggataaatctcaggtttagaagaaaggttggaaaaattcttgaaggtcacaagccagaagtacatggcactgaaacagatctgactcttgagtccaagcctattgtattgacttgctatcaatgcataacaaaccgcatcacacaaaaccagtagtatctttgagtcatcttgggggttggctgatttaagctgggctaggctaggtggctggggtagctctgctctatatgcctctcatcttcctcctgggaccagtaggttgccctggacatgtgtaagaagaaaattggaaatatgcaaggtctcttaaggcctaggcttggaactggcacactaatttctgcctcatcctgttcgtcaaggcaagttacaaggctgagactaatgtcaaagagcaaagagacatacctcatttttttttaagagataagggtatgcctgttgattaggttgtactcaaatgcctgggctcaagggatcatcctgcattgctgggactacaaatgtgcaccactgtgcccaactgagatatacttcacctttgtggggtgtagtggatgctgaggtgcacttcctggtccctttccagaaccaaggcacttactttctcagctgctaggaatattgcttgctgatgatggctcaccaagtccactgactcccatcctttcacctccaccctcgccctggagtccccatcccactgcccaccaggaattgtcctcagctgaagggcactgctttgcccaagggtgcccctatggtcaacccacattcaaagactagtcagatgtgagtatgaagtctgacctcttgcctcaattcaagacatctctgaagagctatcctagcatcagagcttcccataggattgggtgaggcctgggttgcaattaaattagtcccatttttttctgtgtcaatcttgcttcccctattcccttaaaatggctgtttccaagagcattcctcaataattactcnatgaaatctaaccttcaacatgagagggactccaaagccaatggtgaagggcaaagatatagtataggaaagaatcaaaaccaataacgcaatctaccacatctttgcatttaagaagtagattaaactgcatcccaggtccaaaaacaaaagcatatagtngagcagacagaatctctgtctgacatgtcttaatgtatatctaaaccattgatattggaccttgaaatatatttgacttggaaaaggcatgtggtcctgaagagttgtgggcaaatggaaactttgtaaattgaattaaattccaaatgcatggtgggggtttggtattctaaagtgaaaaatgtggtgaattattttatgaataaccattttaataacattgatttttctatgatgagttttacatatcagcaatttatttcatttttatgaacccattctatttttaaaataattctgtgtgtgtgaaattatagcatgatgtcatacgtttgttttttggtctccaatccttggtggatttcctttgcataaattttaagtttacatgaacctgaaaagattccagggactctgggcaaagccatgggtgcatggttgttggaaatgggtacaatggatataagtagccgggcagacaaacatcccaggagaagaaattttggccaggtcatgttcctttgtccagtaaaaaaagcaggaggagagaaaatagataatttactgtactcagggatagggattgataaaatagctacagcagaaggaaaagtcagcaggaaaatcaagaattctaacagaatattgcggatatgactgttcatgatctccaggggtatgaagggcaagccaggctaaaaagtggaccagaacactggtggttgagggattggaggccccagtgagaggagggaataggcacacagcagtgacagattcaatggaagtttttccatatttatgatatgcaagccatgtgtattttcatttccctcatgcttttctgtgaaggttgaggctctcccatgtgatagtttcctctatcagtcaggattctaaatattcttgatattttaaagaagagatttaataccaggagatgacaaaggtaagaagcctaaagtgggagagtaaggcatccttgagattatcaagagcaggaagctgctaccactgcctaaagcttaagggacaaaaggagccaggccaccagggagaagttggaaccacagaagctcttggascaagagctgggtccatagaagagatggccgctgccagagacaatacttgaagctgagagaagtggggaaaaatacccagcttctccctttctgctctctcttcagggccatccaatggctgaactgacccagaaaccagagggcaaaggaacaaggaaaaagtaattctctgtgatacggaacagggtagagcggggacaggggataaatctaagagcaaaayaggacaagactagcacatggcctcaacttctctgctctccatggcaatgtcttcctcctcttctgtttccaggagtctctaattcctgccacttattgccccaggctcccttgatagctggtttccaggtgggggcacagccaatgggtggcagcagcaggagactgggagataaaaggaaaggttgggttatttttccccattccctccctgctttggagccacctctctggaaggctccctccaccattatagatcctgctggtggtctgtcttccgtggctccaggtctcaccagctctcaccaggtctctctctaggagtggtttccttctattgctggtctctgggtgtctcaacatccyttgctaattcccttaattctgcccacagctatgtcagcagtatctttgttaaagtcccttcatttgaacaatttggcttgagttctgttttctgccagaaccctggctagtatcctgacctactgtgttcttttccaagctcctttcaagtgtcatattttccccactgttgcccagatcaacagtgtggtatagtagaaagaatactggacttactggcagacagacatggttttatttctgattcagtcacttacagagttactggctgggaaagttatttaacctcctgagcttccgttttcttgctggtaaagtggaaaggggataatgatgaatttcagttggatatattagaaatccgtgcctgacccatgtgttccaggcctcatctgccagttgtctttttttttacataccgattatttatggcgtaaatccccttcctactcgactgaaagaaatgaacccccttcaaagtatttccagttatttctagaagtttccaaagaagttcccttgctcaccagtcgttctttcacagttgccatcgtcttctgccctgttattttgcttctgccccagctcccacatgtccagcttctgcttgcagggccacttgctgaggctttgccgaggctgaaacttttccagggtcactgtccatcatgagaacacagcacatgccaagggtgttgcctcttagtgttcccaaagagtctggtccttgggaagcctccatttggcctctgtggtgcagagaggagaatgtccttccctggctcagccccaaatagctgggcttgtgcctagagcctctgagagtctctttgactatttcctcagctaatttcacatgtaaacaaaacaactcacagaggttctgcaacctgcttccaccgtctttctagaaggaggtcagaaagggaacagatgctttgcccttttcccctctcccctccacagctctcccaacccccaaacccatcttcctcttctatttgctaaactaaacattttatacttatcaaccactgtgggatggaagtgggatggtcaaggagggaggtgaggtctagatgacttctgtatatgagccagagtccaatccatttatatatgaatgactcctagtacaatatctgacacaaagtggattctcaatggttgatgaatactattatcacgtaaataggaaaccacatttcctaccatttagatagtataagttcttcaaagttcaatttatgtgtcatttcttaccagaaacctggccctaatcccagtaggatgaggttactctttgcctctgtatttgcttcttagggctatggttataatataccaagaattggcttaaaacaacaaaaatttattctctcacagttctggaggctggaagtttgaaatcaagacattgatagagccatcctctctctgaaggctgtagggagagtccttccttgccccttcccagcttctggtggctcttggcaatccttggtgttccctggcttagagccgcttcactcaaatctctgcttctgatgttgcacagtcatcttctccctgtgtgtctttgtttccacgtggcattctcttcccttataaggccatcagtcacagtggattgaggcccactctagtaacctcatttaacttgattatatctgcaaaggccctgtttccaaatgaagtcacattctgggatcctgagagttgggatttcaaaataccttcttggggggtgcaattccacccacaacaccctgcaataagattttaaaattgaatagcagcaatcttatttctcttttgacatctatcacatctagcttattttatagtaatctatcttttatctccccctacaacactgaacagcccaaggacaaaacctgtttctgattcacttttgtgtccctgacaatacctacatgtcccataataggtttgataggtactaagtgaccgggctgaggcttgcaccctcccctcctgactcatgatcaatccttcagactagagcgtgctgccaccagcctggtacatgtatttgtgagttccttgggtttcaactccttggttgatttattttttgaaaacactatatatcaggaagatgggtttggctagctgaaatagctggttatagcttgccttgggtggttaaatatttatgtcttctgagagtgaacaatgggctttactctaccagggaaataatcttgtttgtccccatttattggctcttttttcctcttttacattttcagcatcctaatgatgtccttagtgatagttgctatggaagtattttagtgttttctgcagtgttgggtggtgcagtacctgaagccytctttagtgtgtatttataatgacaccaagccatgaatttcattttagtggtagctttcttgcttaataactggttgtcgtcgggggagtggtctgcatttattttggcctcctgatttatcgcactgatttttcttctccttttcattgttcctggagtgctcgtcatcacttcaaatactcaacccattatttcacagaatataatgacagagccagccccatcattttatcattgaatacactggtaaacagttgcaacccctctaataccaatgtgatgaggggtgatttaaacttgtaaaagtcaaacgctttttttttttttttttttttgcgatggagcctcactctgttgccaggctggagtgcagtggcacagtcttggctcacggcaacctccccctcctgagttcaagcgattctcctgcctcagcctcctgagtagctgggactacaggtgcgccccaccaagcccagttaatttttgcattttttagtagatatacggtttcaccatcttggccaagatggttccaatctcttgaccttgtgatctgcccactggcagatcttgtttgtccccatttattggctgggattaaaggcrtcaaaaacttttaagaatgtatagtttggagactgagactcagtaatgggtggaggagagaaaactgggatwtctagagaattggattgtgatgtcttccgtaaaatagtaatagtagtacatgttctacctacttgataggattgttatgagggtcatgtgattaatgtatgtgaaagcaatttgtaagctgtacagtgctataaaatgtttatatatgttatcattaataacaactagattgttaatagtcctgattgcttttgacctggatgtctatggagaagcagcttaatctctggtgaagacatgacttgacctttttactgaaccatgtgggcaaatgatcaggccattatgcagtattttcaaggccatcaggttgtctgtgttagcctctttcattcgactcttaccttttatttggggaggagaagggacagtatgactttaattattaagctgaagaagtggagaaatcttgatttcttgaatagctttttcaagtcagctctttaatataaagtctctctggtgcatctgttgctagcttgccacgttggtatgtgccattttaattttgttcctccaaaggtttgggttatttttccatacactttggtttacggtagacgctcaaccacttactagaatagaacacacttaggcatgtagactttgacaattctagggaaaagttgtgaatgcatttagtgatttgatttgtgtgttttagtttaagtaatctatcaatttatcctatagatagcccagaaattgatgtcactgcaattaaacagaatttttttataaagaattctgtgcctgacaactctagacatatttattatgcagcttctcttaaaggattttcaatttgctcattnrgagcaaattttgtgtgttaaatgcagttggttcctagacactgactcattttccaaatctgagtacactttttcctcaattgactttcccctgccagtatgtcatccaactattctttaatgtactgtcaaaatatggtcacctcatcattaacaggaaatgggcttcttgcccagtcttwtgaaagtagaataaaatcagacagtttgatttttaaactataagaaaaggagaatgaaaaaacagcaaaacttaactaatttccaagctcagggctatttataaagagcttgaacaaataagacacccagaaacgaaaggaaaactgcaatttgcttggctttgtgtagaatacagaagaatttccattttactctaaatataaagtagctgcaatgtgagtcaacataaataaaacaaagaaaccaagtctttatggaagatgacagcagtttcatgtgggcagcttcatgtgtttaagcatctcaatgtgaaaacttggccatttgctcaagattgtttctctgtatttagatttttggtgcaaatatcatctctgtctctaggaaacaaacccagacggcctacagagtcaagaatgaagaattcattttactgaaatgytaatgtcaactctraaaatatcagagttttcaattttacctaatcaaataatcagctcgacaatttttttgcaaccacagttgcttatagggctgaccaaagtgacgatttgtttaagaccaagttcaaggttagttaaacatataacatatagcgcagatttcatttaaccatgtggataattcagccaaatatgtttttcatgaattgctgtgaaaaagagtaatttgccgcatttgaattatctgattacctgtcctgatcttctacttcactttgagtgtatatgtagactttattagaataacattttgtagtgtaaaaatagtctatgtcgccacagcttctctctacttgctagttcaaagctttctctttaatttttgatcagtgccaatttggaaccgatctcttttagctcagtttcctcatttgtggagtgggtatcttaacgtccaaaataataaatgattaaaaatagttaaaaaaagttaaaaataaatgattagtggaatgatgaaaagtacttcacacagaatccagcatatagtgaatgctcaatgaattttaactattttgacttttactgttaaagatgtgacgtgggaagtcattaaaccttttgtagcttagttctttaggtatgaaagacaaatgtcttgatataagtctaaaaatgttcttaaaatgcatgcagtgcctccacatgcaaagtgaagcacagaatttaagtaattaccttcattaattaatcaatgcattgctttacctaataggttgatacatgttttagagcaaagcttgatgcacaaaggtccactttgcttggatattagttttattgtcattttgccatttttttggtattcattatctactgtgatgggacaagaatttgggtgaaagtagtttacttgggaggtgatcccaggaggcatgatcagggagtgggcaagtaagactggcaaaagaggaacaccattaaaggatacattgagaagcgggttactgtcttgggcaagtgagctcaatcccagtggcatctctttgagaggctgcataaaacctttgagcaacctcatccatttagtccagcactgtactaatattatcactttctacgagcaataccacatgaaaaaatttggggagcattgctataaagaatggttgagagtgctgaagagaagccaggaaaataaaaagcagaataaataagaatggttgacatgcacggtggctcacacttgtaattccagcactttgggaggcggaggcgggaggatcacttgaggccaggagttaaagaccagcctgggcaacattgcgacaccccatctctacaaaaaaattttaaaattagctaggcatggtggcacatgctggtctcgaaaacctggcctcaaatgaccctcccgccttggcctcccaaagtgctgggattacaagggtgagccaccgtcctggcctggttacatttaactatgttgcagagaagatcgtggattcattcaaaatgaaatcattgttgctgggttcttgtaaaagtaaggttgttgagctatgggcattgagcatatgagaacagaaacataatccttttaatctactcagcattttgcaggcttcagaggaataatggctgttgtttctggctttgcagttcaagtgagatggatttagaagagctccaagcacattcctaaagtattaggtggttggaaggttctatgagttacgtagttgttacttcagtctccagcggaagggaggagacatgtcttcctagtcatattcctccttggtctcaaaaaaccacattttgttcccttcaagtcaggaatgtagccagaatgcccaccaggtggtgctccaattactttactgtataacattttgtgacctcctgtaggatataagaatattaaatgttagagttaaaggcagaaaatattctgtaacttgagcctcaagatgtaaagacttcatatattgagaagactaatatggcttttaaaatatcacatgacatcaaaatgtctatgcataaaaggtgaaaaaaaatgctatctcagagccaaggttaacattcttggtagaaaaatagattacaatcaatattttttaattgagytttaaaaagaattctgatgcactaggttctgaggcattacaaggatatatatgtatatatatatggcaatttccccccacatttacttatttatttttaattttattattattatactttaagttttagggtacatgtgcacaacgtgcaggtttgttacatatgtatacatgtgtcatgttggtgtgctgcacccattaactcgtcatttagcattaggtatatctcctaatgctatccctcccccctccccccaccccacaacagtccccagagtgtgatgttccccttgctgtgtccatgtgttctcattgttcaattcccacctatgagtgagaacatgcggtgtttggttttttgtccttgcgatagtttactgagaatgataatttccaatttcatccatgtccctacaaaggacatgaactcatcattttttatggctgcatagtattccatggtgtatatgtgccacattttcttaatccagtctatcattgttggacatttgggttggttccaagtcttcgctattgtgaatagtgctgcaataaacaaatgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtctcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatgggattgtttttttcttgtaaatttgtttgagttcattgtagattctggatattagcccttggtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaggtccttgcccatgcctctgtcctgaatggtattgcctaggttttcttctagggtttttacggttttaggtctaacatgtaagtctttaatccatcttgaattaatttttgtataagatgtaaggaagggatccagtttcaactttctacatatggctagccagttttcccaccaccatttattaaacagggaatcctttccccattgcttgtttttgtgaggtttgtcaaagatcagatggttgtagatatgcggcattatttctgagggctctgttctgttccattggtctatatatctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattatcttgggcagtatggccattttcatgatattgattcttcctacccatgagcatggaatgttcttccatttctttgtatcctcttttatttcattgagcagtggtttgtagttctccttgaagaggtccttcatgtcccttgtaagttggattcctaggtaatttattctctttgaagcaattgtgaatgggagttcactgatgatttggctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacaggaacgatttgacttcctcctttcctaattgaatgccctttatttccttctcctgcctgattgccccggccagaacttccaacactatgttgaataggagtggtgagagrgggcatccctgtcttgtgccwgttttcaaagggaatgcttccagtttttctccattcagtatgatattggctgtgggtttgtcatagatagctcttattattttgagatatgtcccatcaatacctaatttattgagagtttttagcatgaagcgttgttgaattttatcaaaggccttttctgcatctattgagataatcatgtggtttttgtctttggttctgtttatatgctggattacacttactgatttgtgtatgttgaaccagccttgcatcccagggatgaagcccacttgatcatggtggataagctttttgatgtgccgctggatttggtttgccagtattttattgaggatttttgcatcgatgttcatcagggatatcggtctaaaattctctttttttgttttgtctctgacaggctttggtatcaggatgatgctggcctcataaaatgagttagggaggattccctctttctctattcattggactagtttcagaaggaatggtaccagctcctctttgtacctcaggtagaattcggctgtgaatccatctggtcctggactttttttggttggtaagcgattgattattgcctcaatttcagagcctgttattggtctattcagagattcaacttcttcctggtttagtcgtgggagggtgtatgtgtcaaggaatgtatccatttcttctagattttctagtttatttgcgtagaggtgtttatagtattctctgatggtagtttgtatttctgtgggattggtggtgatatcccctttaccattttgtattccgtctatttgattcttcctcttttcttctttattagtcttgctcgtggtctatcaattttgttgatcttttcaaaaaaccagctcctggattcattgattttttgaagggttttttgtgtctctatttccttcagttctgccctgatcttagttatttcttgccttctgctggcttttgaatgtgtttgctcttgcttctctagttcttttaattgtgatgttagggtgtccattttagatctttcctgctttctcttgtgggcatttagtgctataaatttccttctacacactgctttgaatgtgtcccagagattctggtatgttgtgtctttgttctcattggtttcaaagaacatctttatttctgccttcattttgttatttacccagtagtcattcaggagcaggttgttcagtttccacgtagttgagcagatttgagtgagtttcttaatcctgagttctagtttgattgcactgkggtctgagagacagtttgttataatttctgttcttttacatttgctgaggagtgctttacttccaactatgtggtcgattttggaataggtgtggtgtggtgctgaaaggaacgtatattctattgatttggggtggagagttctgtagatgtctattaggtcagcttggtgcagagttgagttcaattcctgggtatccttgttaactttctgtctcgttgatctttctaatgttgacagtggggtgttaaagtctcccattattattgtgtggtagtgtaagtctttgtaggtcactaaggacttgctttatgaatctgggtgctcctgtattgggtgcatatatatttaggatagttagctcttcttattgaattgatccctttaccattatgtaatggccttctttgtctcttttgatctttgatggtttaaagtctgttttatcagagactaggattgcaacccctgcctttttttgttttccatttgcttggtagatattcctccatccctttattttgagcctatgtgtgtctctacacatgagatgggtttcctgaatacagcacactgatggttcttgactctttatccaatttgccagtctgtgtcttttaattgaggcatttagtccatttacattcaaagttaatattgttatgtgtgaatttgatcctgtcattatgatgttagctggctattttgctcgttagttgatgcagtttcttcctagcctygggggcctttacaatttggcatgtttttgcagtggctggtaccggttgttcctttccatgtttagtgcttccttcaggagctcttttagggcaggcctgatggtgacaaaatctctcagcatttgcttgtctgtgaagtattttatttctgcttcacttatgaagcttagtttggctggatatgaaattctgggttgaaaattcttttcttgaagaatgttaaatattggcccctactctcttctggcttgtggggtttctgcygagagatcagctgtttgtctgatgggcttccctttgtgggtaacccgacctttctctctggctgcccttaacattgtttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagartattttccaacttggttccattctccccgtcactttcaggtgcactgatcagacgcagatttggtcttttcacatagtcccatatttcttggaggctttgttcatttctttttattctgttttctctaaacttctcttctcacttcatttcattcatttcatcttccatgactgatagcctatcttccagttgatcacatcggctactgaggcttctgcattcatcacatagttcttgtgccttggttttcagctccatcacatcctttaaggacttctctgcattggttattctagttatgcattcgtataattttttttcaaagttttgatcttctttgccattggttcaaacttcctcctgtagcttggagtagtttgatcatctgaagccttcttctctcagctcgtcaaagtcattctccatccagctttgtttcgttgctggtgaggagctgcattcctttggaggaggagaggcactctggtttttagagtttccagtttttctgctctgttttttccccatctttttggttttatctacctttggtctttgatcatggtgacatacagatgggtttttggtgtggatgtccttcccgtttgttagttttccttctaacagacaggtacctcagctgcaggtctgttggcgtttgctagaggtccactccagaccctgtttgcctgggtatcagcagcggtggctgcagaacagcggatattggtgaaccacaaatgctgctgcctgatcattcctttggaaattttgtctccgaggagtacccggccgtgtraggtgtcagtccgcccctactggggggtgcctcccagttaggctactcaggggtcagggacccacttgaggaggcagtctgcccrttctcagatctccagctgcatgctgggagaaccactactctcttcaaagctgtcagacagkgayatttatgtctgcagaggttactgctgtctttttgtttgtctgtgccctgcccccagaggtggagcctacagaggcaggcaggcctccttgagctgtggtgggctccacccagttcgagcttccctgccgctttgtttacctaatmaagtctcggcaatggcgggtgcccctcccccagcctccctgcggccttgcagtttgatctcagactgctgtgctagcaatgagcaagactccgtgggcataggaccctctgagccaggtgtgggacataatctcctggtgtaccgttttttaaacccattgggaaagcacagtatttgggtgggagtgacccgattttccaggtgctgtctgtcacccctttctttgactaggaaagggaattccctgaccctttgcgcttcccgggtgatgcgaagcctcgccctgctttggctcgtgcacggtgcgctgcacccactgtcctgcacccactcactgtctggcacaccccagtgagatgaacctgatacttcagttggaaatgcagaaatcacctatcttctgcatcactcacgctgggagctgtagactggagcttttcctattcagccgtcttggctcctccctctgtttatttattttgagacagagtcttcctctattgcccaggctggagtgcagtggtgtgatctcgggtcactgcaacctctgtctcccaggttcaagtgattcccctgcctcagcctcctgagtagctgggactacaggcacgtgcctcaacacctggctaatttttttttttttttgtatttctaggagagacggggtttcaccacgctagccaggatggtctcaatctcctgatctcgtgatccacctgccttggattataggcgtgagccactgcgcccagcccctcctcccacatttatacatgtgatgtctttcaatatcatctcagaatggataagatgtagatcaaaaattctgtcaaaaacagtgcaaaaaaatgcaagcagacgaaataccaattttcaaggtaagcaagcaagactagagttaaaagtagactatgtggttgggtgcattggctcaggcctgtaatcccagcaccttgggaggccaaggtgggtgaatcaaatgaggccaggagtgaaaccctgtctctactaaaaatacaaaacaaattagcgaggcgtggtggagcacacctgtaatcccagctactcaggaagctgaggcatgagaatcacttgaacccaggaggcagaggttgcagtgagccaagatcgtgccattgcactccagcctgggcaacagagtgagactctgtttcaaaaaaacaaacaaataaaagtagattatgttattactggacagttactactgaatgaatccaaatatttgctttcttcagccttacacttggactgccaggctgctagagaaacataacaggacaatttcgtgtcatctttaagtcaagactttaaacagaatttctggaaggaagcaacttaaatgcatttcctccactttcattgccagcctaacacagctgtcgtctcctgagccattgagttcttgggcctacagtggctggagagtgctggctctgttggagtcctcatgaaaaagtagaattggactttctcccagtgggccaactggaactccttcaatcccaccaaacgggtaacagaaacgtccatagcagtggtgttcataatagcaaaaatgcaaaactatctatacatcaattagtagcaaaatgaattaatcagttgtcatattttatacagtgaaatattgtatagcagtgacgaggaaggaactggagctccatgtttccacatggataaatctccaaaatatagaactgaacaaagaaagaaaataagcaagtagcagtagcatgctagaatattatataactaataaaaagttaaaaactgggccaggcrcagtggctcacacctgtaatcccagcactttgggaggccaaggtgggtggatcagctgaggttgggagttcaagaccagcctggccaacatagtgaaacccagtctctactaaaaacacaaaaattagctgggtgtggtggctcacgtctgtaatcccagctacttgggaggcggaggcatgagaattgtgtgaacccgggatgcagagggttgcagtgagctgagatcatgccactgtactccagcctgggcaacagagtgagactgtctcaaataaaataaaataaaccaaaaacaaaagttaaaaattataaaacaataccatttacatatatatatatatacatgcatacatatgtatgtatgtaaatacatatataatagtaaaaaagaaaaggtagtggttacttttagtaagggaaaagcatgggtggaaagacatatatargagcttcaattttaatggtaccatcttaatttgtaagctgaatggtagatgaagaaatgatcattaagatgtaatgatatatttgggaggccaaaacaggcagattgcttgtgctcagaagtttgagaccagcctgagcaacatggtgaaacccatctctaaaaaaagaaaatagaaaaaaattagctgggcgtggtggtgcatgcatgtatttggggggctcaggtgggagaatggcttgagcccaggaggtcgaggctgccatgaaccagggttgcgccactgcactccagcctgggtgaccaactgagaccctgcctcaaaaaaaaaaagatataatgatatatgaaatgtaagattttttttttgcgtgtctcaaataagtcaaagaagcatgggggagaataagaaaaaggagaggaggaagaggaagaggagaagaggaagaaggagaagaccaccttggaaggacaaagaataggaaccagcaggcctgtgagttccagtgggtgtgttgttttgggcaagaagttaccatcagagagactcagtacaagaagagggaatgctgagaggcattcctgaggtcagagagtgtgtttgctgggaaaatcagatgacatgggatgggaaggtatcctttcaaaaggggcaggtccatccattccttcaatgtatatttatgtgctctgcactgttctaggacacagcagtgaacaaatcagcccaaaatctgccctcatgagcttaggtgtctggcaggcaaattctgtatctagcctgtttgtgtgaacttcctarctaggcattcagggaaggacagagatttatttactctacaaatatatattgaacacttcatatatgtcaaataatgctggatgctggggagatggaatgagtccctgtcttcaaggaacttacaatgcagtgggaaaagccttatatgcagttacccatttaaagttaaatgtgttggaggcaagcagagtaccttgggaacacagcagaagccggggggtggtagggagtgttggagcctgcttctgcttggaaaatgagttgatttcagagaaccacgatgtgaattcagaatcagtgtcagttcattagcatagattaaagattctggccaggcgcggtggcttcatgcctgtaatcccagcaatttgggaggccaaggcgggtggatcacaaggtcaggagatcgagaccatcctggctaacatggtgaaaccccatctctactaaaaaaatacaacaaaaattagccaggtgtggtggcgggcacctgtagtcccagctactcaggaggctgaggcaggaggatggcgtgaacccgggaggtggagcttgcagtgagccgagatcgtgccactgcgctccagcctgggtgacagagcgagattctatctcagaaaaacaaacaaacaaacaacaacaaaacaaaacaaaacaaaaaaagattctgtgtttgagctgggcacggtagctcatgcctataatcccagcaatttgggagcctgagatgggcagatcacttcaagttgagagtttgagaccatcctggccaacatggtgaaaccctgtctctaccaaaaatacaaaaattagccgggtgtggtagtgggtgcctgtaatcccagctactcgggaggctgaggcaggagaatcacttgaacatgggaggtggagattgcagtgagccgagattgcacctctgcactacagcctgggtgatagagcgagactgtttaaaaaaaaaaattctacctttggagcatatacctaaaggtagccttatgctctrgggcactaggaagtctgttatccaaaaccatctctcttcccttccatgtgtcctcctaccaccagtctgttgctattagaaattcattccattgcctccattttattattttaaataacacactattctgttgaaaattattttataaatacaattcttataatcgaatttacaactttaatgttttgacaggagctatgtcccgaaatgtcttattgacaaaaacaccaaaatatctgtgacattctgagagacacaatataatacacaatcaggacacaatgtgttttttttttcttcttcatgttttccaaggcatgaagagtacagtagagaaaaaaggagttatggatgagggagtggcttcagccaggaagggatccatgaaagaggagggaaagcgtgtccagcagttggggaggtaaaagagagtatagtttttatgaacaaagctacagactagggagaaaaaaagatatagactaggagatcttccccatcaacattactctggaaatctgtggaacagttttttcctatgtgagaattatactgaaacaatgaagcaaataagaaaaaaagactatttgttcattcaaatattctgttatgcttattttatgacactgtgatagatactaggagtacagtctctgaagcacccattgaaggcagtagattgtgactgcttatagtgttcattctcctacccaaaggggtgaaattacggtctgtgaaaccctaaacccaattcattgagggagtagtactagaagtttggcttctaaaatcatgtttccgagtcctgtcttaaggaaggacttgagcttatgaaagttttatatgagggaaaccacacattagagctggaaaatcttacagcttactttactgcttttttctttttttaacttatggaaactgcattccctaagtctgagaggaaaaggaaatttctgcttcacacccttttcaattctcatatggagtagtttgcttttacattgtagggtaccagcttcaggaactactagagaagcttctgtcagcttttttcagagaaaccttgtgtggatccgtcaatgcagtgtccctgggagaatttccaggaactcatgactgctggaaccacctaccccaggcaggctccagtcaccctctgttttggagaactatatgactagattgtggcaagtttctctttgcatctagggatgttaggggaaggtggtgatggcggcgctacaggagaaacaatgawtatagtgaatgaaattagtctcattaaaaagtggtggaggttctactatgtgctagcactgtgccaggctccaaagcctggataataacacagagaccctgtgctcaagggaatcacagacaagtgggtgagacagattaatgtgtgataaatgcaaaaagcagccaaagtatggtactatggtagcatggggtagagaggaggcagggaagtccwgttgagtgaggctgtggctgagtcctaagggatagtccttaacaaggggaagatttgggggaggaatttccagactgaagacaccctataccatgaagtaagtttggggcctgtaagtagctcataataatgagaagggaagaggacaagagatgaggctgaagagagagacagaccagataacatgaggccccttgtttgccatgctaagaaatctggacaccctcaacagtccttagggatactgagggagcctgaggaaggcagtgagcactttcaaatagtttttgttttygtttttattttttctcctrtaaaattaaaaaattctcattgaagaaaatttggaggtgacagaaaggcataaagagaaaatatgtcacctttaatttctccacacagaaataaccactgccaattttggtatatttggtatatatctttttatatgtttgtggtcactttgtttatacaactttacatttgctttttcattaacgttctttcctgggcatttccatactttgtattcttttttttttaaataaacttttaattttgaaataattttagactaacagaagagttagaaagacaatgcagacagttcctgtaggtccttcccccagcttcccaggatgttaaccaagtactttctttcttgtttttttttgagatggagtctcactctgtcacccaggctggagtgcaacggcatggtcttggctcactgcaacctccgcctcccaggttcaagcgattctccggcctcagcctcctgagtagctgggattacaggcgtgtgctaccacgcctggctaatctttgtagttttagtagaaacggggtttcaccatattggtcggctggtctcgaactcctgacctcatgatctgcctgcctcggcctyccaaagtgctgggattacaggmgtgagccaccatacccagcatgtactatcttttttttwaaaaaaaattttcattgaggtaaaatatccatatataatttaccacctttaccatttttaggtgtatatttcagtgttattaaatacatttatattcttttttccctttatctctctcttcccccatccctcctggcctctgctaaccacagyctactctctatcttgatgagatccacttttttagctcctgcatatgagtgagaacatgaaatatttgtcttttgtctttctgtgcttgtgttatttcacttaacatcatggcctccagttccaaatacaaatgttgcagttgctgcaaatgacaagatttcattcctttctgtgactgaatagcattcaatatgtaccagttttcttttatctattcatccattgatgagtactttggttgattccattccccggctattgtgaatagtgatgcaataaacataggagtgcagatatctcttcsatatattcatttcctttcttttgtatatatacccagcagtggaattgctggatcacgttctgttttcaggttttagttttttgaggaaactccatactgttctccatagtgggtactagtttacattcccaccaacagtgtatgagggttcccgtttctccacatcctcagccgcatctaacaacaaactttctatctttcccatcacagtatcaaaatatatttacctctatcatattttcactgatactctaaaatgaccactaactaaactgaaaaactgaccccatagtactatgagttcatagacatgcccaacctgaaacccaactgtacttgaataagagcctcctggagtcacagtgcattaccctggaggagtgggaattctggacaaaagtagcatgctacacagagaggtgctcctgggcagatgggactttcaggaccccacagcttagcctgcatgtgggagcagctggtgtgtactaattccagatgaattctcactcactaagatattgataagtgatctgcaggcatttctccttatgtttattaaaaaaagccatacaactgagttttttgtgatcttgaccagttttaaccctaagtctgatccagcatttactgacattgcttaaagccagtactaaatgatttatgctcaattctaaagtcctgggttgaatcacttggtccttccagattgwccaaggaaaataccatgtgctggcaaaggtcaccgttaatgagggaaacaaattatccctgaggctcagtcctagcccctctgtgtgttccttttcaacatccaatgtgacctcgtctttctctaagtactcttagcacttanctgtcctcttttggggccattttcatcctctgtcatttgcatagttgtgtctgtgtatatttcttattattttgtatatttcttgagaatatcttctcccttcttatgtatttcacagtactgatcatagcaccttactatccgatgctaaacaaatatttgttcctttgaatttattaattctctatgctttttcttttagaggtgtcatggagtctcacagcttcagctaagatcttttagtacgtaaattctgttgggtatctccaactgcttcctaaatggttctacccagtaacytactttcattgctaattccaaaaagctaatactgaaacagtccctcccttagtctctccctgttatgagctgaattgtgtctccctgctccctccaccaaattcatatgttgaattcctaactcccagtacctcagaatgtgaccgtatttgaagatagggtctttaaagatgtaattaaggtaaacgtaaaatgaggtcttatggctgattgtctttatgcaaagaggatattaggactcagacacacacagttggaagaccatgtgaagacacaagagagaagacagccatctgtaagctaacgagagaggstgcaaaagaaaccaaacctacaaacactttgactttgaacttctggcctccagaaccataagaaaataaatttctgtggtttaaactacctagtctgtggtattttgttatggcagtcctactaaacgaatrtacttcctttacctgaattataagctgactttcccaatacacctccacatttctgtcatgtaccagcattctctcaggcataactatctgggagtctttttttctagtactctcactcttctcatcattaattgttttgctttttttaaaaaaattaccccttattggcacagctattactctagtcctcctcagttttgattcttatttcatagcctcaacacattttcctcaaatacagttttatatagatctcagtatctgatttctctgttataatatactcccacatgctttctgagtgccactcatatgaaatgatcaacaattcaaccatatctttgcccatattattgcctttgttgggagtggcctttcttctcttccccagggcttagtggtttgtggatctggacatgtaactacatgccttcttgttgacctcttatatcccctgtacttctgaacttggcatatgttcttgacttccctagtctcaacctccaaatctacctctctgctctgttcctactccagttacagtttaaaatattagattaacattgaatactccctgatttcaaagaggcacttctccatatagttataccacatatataggtggcagatactgaagattaatatagcgttaagttagagtttttggtttcgtgtcagattttttattaactcggtggctttgggaaagtgctaacactttttttcagcctcaactctaaagtaaagataaaaatatgtgatttcacttgagcattatgaagaaaaatagattaagtatgtgaaagatttgtaaggcatctacaaaacaatatttggtattatttgttgagtttggccttcttgatgcttcccatattgtcttttattgccaygaatcctgtcttcccaagtgcctgacaaactcgtttggggcctaaattataggtaatatattctttctgactcttaaagtacctagtcatcatttaatactgatttttttttaaaagctaactcctaaaatcacagtagttgaaaagccttttaagtagggtgattatttaattaactttgcatgacatggttctagctcacccttgtaatctcggcatcattattatagtatatttcttactctcaaaagtgtgcttatttggacaacagattatatggtcactctccccataagtatcctggcttaaacagaaccacagaagtttgtttcatgaagataaaaagaacatagagcaaacttttttctgtgggaaagaagaacatgaaagagagagrgttgagtctctacttgggagaatatttcatctagcagagattgtaaagtctgtgggtaaaatttattgtacttaaatgtttgcatgtcagataagacaaaccagctgcacttcactacaattgccaagtttggtctttgcatttaacttttggcagatgtgcttgtacgctattcaggtcaaaaagctattaatcaaactgttaaaatgtgttgttaaaagttgaagatgtagtctatgttctgatcttaaacagtttttatttgtttttattactcaagtaatacatagttactcaatacatactcaacatacatacttttattgtctagttaaaattatatcaaaatatatagactgaaaaatgtctctctccatcatcactcacccctcatttacctaatctcacttttccatatgtaaaccaattttaaccagaaacaacgcaaaataaatattgagtatgaatgaattgtaaatatcaagacgttccataaaagtaacaaattactaacttttaataaatagtccaacttttctggaagaaaatttgtcaaaatacatcagtgttaaacatgcagttttagactcagcaatttcaattcaaagaaataattggacaagcatacaaggatatacatgtaaagatattcattgcaacccaggagctgaattttgcaaagattaacaaaaaatatagaccactagccagactaataaagaagagagaagaatcaaatagatacaataaaaaatgataaaggggatatcaccactgaccccacagaaatacaaactaccatcagagaatactataaacacctctatgcaaataaactagaaaatctagaagaaatcgataatttcctggacacatacaccctcccaagactaaatcaggaagaagtcgaatccctgaatagaccaataacaaattctgaaattgaggcagcaactaatagcctaccaatgaagaaaaaagtccaggactggacggattcacagctgaattctaccagagatataaagacagctggtaccattccttctgaaactattccaaacaacaaaaaaagagggactcctccctaactcattttatgaggccagcatcatcctggttccaaaacctggcagacacaacaaaaaaagagaatttcaggccagtattccagatgaacactgatgcgaaaatcctcaataaaatactggcaaaccaaacccagcagcacatcaaaaagcttatccaccactatcaagttggcttcatccctgtgatgcaaggctggttcaacatatgcaaatcaataaacgtaatccatcacagaaacagaacgaatgacaaaaaccacatcattatctcgatagatgcagaagaggccttcgataaaattcaacaacgctttttcctaaaaactcgcaataaactaggtattgatggagcatatctcaaaataataagagctatatatgacaaaaccatagacaatatcagactgtaagggcaaaagctttgaaaactgtcacaagaacaggatgccctctctcaccactcatattcaacatagtattggaatttctggccagagcaatcaggcaagagaaagaaataaaggtattcaaataggaagaggaagtcaaattgtctctgtttgcagatgacatgattgtatatttagaaaaccccatcgtctcagcccaaaaactccttaagctgataaagagctttggcaaagtcttgggatacaaaatcaatgtgcaaaaatcacaagcattcctatacacaaataatagacaaacaaagagccaaatcatgagtgaactcccattcacaattgctataaagaaaataaaatacctaggaatacaagttaccagggacatgaaggacgtcttcaaggaaaactagaaaccactgctcaaggaaataagacaggacacgaacaaaaggaaaaacattccatgctcatggataggaagaatcaatattgtgaaaatggccatacttcccaaagtaatttatagattcaatgctatccccatcaagctaccaatgactttcttcgcagaactagaaaaaactactttacatttcatataaaaccaaaaaagagcccgtatagccaagacaatgctaagcaaaaagaacaaagctggaggcatcatgctacctgacttcaaactatactacaaggctacagtaaccaaaacagcatagtactggtaccaaaacagatatatagacaaatggaacagaacagaggccccagaagtaacaccacacatctacaaccgtctcatcttcaacaatcctgacaaaaataaacaatggggaaaagattccctatttaataaatggtgctgggaaaattggctagccatatacggaaaacagaaactggatccatgccttacaccttatacaaaaattaactcaaggtggattaaagacttaaacataaaacctaaaagtataaaaaccctagaagaaaacctaggcaataccattcaggacataggcatgggtaaagacttcatgactaaaacacccaaagcaatggcaacaaaagycgaaattgaaaaatgggatctaaataaactaataagcttctgctcagcaaaagaaactatcatyagagtgaacaggcaacctacagaatgggagaaaagttttgcaatctatgcatttgacaaagatctaatatccagagtctacaaggtacttaaacaaatttacaagagaaaaacaaccccatcaaaaagtgggcaaaggatgatgtgaacagacacttctcaaaagaagacatttatgtggccaacaaacatatggaaaaaagctcatcatcactggccattagagaaatgcaaatgaaaaccacaatgagatgccatctcctgcctgttagaatggtaatcgttaaaatgtctggaaacaacagatgctggtgaggatgtggagaaataggaatgcttttacggtgttggtaggagtgtaaattagttcarccattgtggaagacagtgtggcgattcctgaaggatctagaactagaaataccatttgacccagcaatcccattactgggtacatacccaaaggattgtaaatcattctaccrtaaagacacatgcacacgtatgtttattgtagcactatttacaataagcaaagacttgtaaccaacccaaatgcccatcaatgacagagtggataaagaaaatgtggcacatatacactatggaatactatgcagccctagaaaagaatgagttcatgtcctttgcagggacatggatgaagctggaaacaatcaccctcaaaaaactaacacaggaacagaaaaccaaacactgcatgttctcaatcataagtgggagttgaaccatgagaacacatggacacagggaggggaccatcacacactggagcctgtcagggggtgggggcaagaggagggagagcattaagacaaatacctgatgcatgtggagcttaaaacttatgtgacgggttgataggtgcaggaaaacaccatggcacctgtatacctatgtaacaaagctgcatgttcagcacatgtatcccagaacttaaagtaaaatgaaaaaaaaaaaaagatattccaagattcttccaagatggctaaataggaacagatctggtctgcagctcccagcaagattgacacagaagacgggtgatttctgcatttccaactgaagtacgtggttcatctcattgggactggttggatggtgggtgcagcccacggagggtgagctgaagcagggcagggtgtcgcctcacccaggaagcacaagaggccagggatttcccgttcctagtcaagggaagctgtgacagtctatacctggagaattggtacactcctgctcaaatactgtgcttttcccatggtcttcacaactggcagaccaggaaattcccttccatgcctggctcgccaggtcccactcccacggagccttgttcactgttagcgcagcagtctgtgatcaacctgcgacactgcagcttggcgtggggagggggtgtctgccattgctgaggcttgaataggcggtttggtgctcacagcgtaaacaaagagcctgggaagcttgaactgggtggagcccactgcagctcagcaaggcctactgcctctctagattccacctctgtgggcagggcatatcagaacaaaaggcagcagacagcttccgaagacctaaacattccggtctgacagctctgaagagagcagtagttctcccggcacagcgttcaagctttgagaatggacagactgcctcctcaagtgggtccctgacccccgtgtagcctgactgggagatacctcccaataggggcaacagacacctcatagagacagggggcccctctgggacaaagcttccagaggaaggatcaggcagcaatatttactgttctgcagcctctgctagtgacacccaggcaaataaggtctggagtggacctccagaaaactccaacagacctgcagctgaggggcctgactgttagaatgaaaactaacaaacagaaagaaatagcatcaacatcaacaaaaagcacatccacaccaaaaccccatctgtaggttaccaacgtcaaagaccaaaggtagataaaacaacaaagatggggagaaaccagagcagaaaagctgaaaattccaaaaancagcacacctcttctcctccaaaggatcacagctcctcgccagcaagggaacaaaactggatggagaacgagtttgatgagttgacagaagtaggcttcagaargtcrgtaataacaaacttctctgagctaaaggagcatgttctaacccatytcaaggaagctaaaaacctcgaaaaaaggttagatgagtggctaactagaataaacagtttagagaaggccttaaatgacttgatggagctgaaaaccacagcacgagaactttgtgacgcatgcrcaagcttcaatagctgatttgaccaagtggaagaaaggatatcagtgatcgaagatcaaattaatgaaataaagcaagaagagaagattagagaaaaaagagtgaagagaaaagaacaaagcctccaagaaatatggggctatgtgaaaagaacaaatctacatctgattggtgttcctgaaagtgacggggagaatggatccaagtaagaaaacattcttcaggatatcatgcaggagaacttccccaacctagcaaggcaggccaacattcaaattcaggaaatacagggaacaccacaaagatactcctcgagaagagcaaccccaagacacataattgtcagattcaccaaggttgaaatgaaggaaaaaatgttaagggcagccagagagaaaggtcgggttacccacaaagggaagcccatcagacaaacagctgatctctcggcagaaaccccacaagccagaagagagtaggggccaacattcaacattcttaaataaaataattttcaacccagaatttcatatccagccaaactaagcttcataagtgaaggagaaataaaatcctttacagaccagcaaatgctgagagattttgtcaccaccaggcctgccttataagagctcctgaaggaagcactgaacatggaaaggaacaaatggtaccacccactacaaaaacatgccaaattgtaaagaccatcaatgctatgaagaaactgcatcaattaacgggcaaaataacctgctaacatcttaatgacaggaccaaattcacacataacaatattaaccttaaatgtaaatgggctaaatgtcccagttaaaagacacagactggcaaactaaattgtcaagacccatcggtgtgctgtattcaggagacccgtctcacatgcaaacacacacataggctccaaataaagggatggaggaagatctaccaagcaaatagaaagaaaaaaaaaaaaaaagcaggggttgcaatcttagtctctgataaaacagacttctattaaatccactgcagtctctgataaaacagacttagtctctgataaaaccaacaaagatcaaaagagacaaagaaggccattacataatggtaaagggatcaattcaacaagaagagctaactatcctaaatatatatgcacccaatacagggacacccagattcatcaagcaagtccttagagacctacaaagagacttagactcgcacacaataatcatggtagactttaacaccccactgtcaatattagacagatcaatgagacagaaggttagcaaggatatccaggacttgaactcacctctggaccaagtggacctaatagacatctgtagaactctccaacccaaatcaacagaatatacattcttctcagcaccacgtcgcacttattctaaaattgaccacgtaattggaagtaaagcactcctcagcaaatgtaaaagaacagaaatcacaacagtctctcagaccacagtgcaatcaaattacaactcaggattaagaaactcatccaaaaccacacaactacatggaaactgaacaaccagctcctgaatgactgctgggtaaataacaaaacgaaggcagaaataaagatgttctttgaaaccaatgcgaacaaagacacaacataccagaatctctgggacacatttaaagcagtgtgtagaggaaatttataacactaaatgcccacaagagaaagcaggaaagatctaaaatggacaccctaacatcataattaaaagaactagagaagcaagagcagacaaatttaaaaggtagcagaaggcaagaaataactaagatcagagcagaactgaaggagatagagacacaaaaaaacccttcaaaaaatcaatgaatccaggagctggtttttgaaaagatcaacaaatagatagaccactaccaagactaataaaggagataagagagaagaatcaagtagacacaataaaaaatgataaaggggttatcaccaccaatcccacagaaatataaactaccatcagagaatactataaacacctccatgtaaataaactagaaaatctagaagaaatggatgaattcctggacccatacaccctcccaagactaaaccaggaagaagttgaatctttgaatagaccaacagcttctgaaattgaagcaataattaatagcctaccaaccaaaaaaagtctaagaccagatggattcacagccgaattctaccagaggtacaaagaggagctgctaccattccttctgaaactattccaaacaatagaaaaagagggaatcctccctaactcatttcatgaggccagcatcatcctgataccaaagcctcacagagacacacaaaaaaagagaatttcaggccaatatccctgatgaacatcgatgcgaaaatcctcaataaaatagtggcaaaccgaatccagcagcacatcaaaaagcttattcaccacgatcaagttggcttcatccctgggatgcaaggctggttcaacatatgcaaatcaataaacataatccatcacataaacagaaccaacgacaaaaaccacacgattatctcaatagatgcagaaaaggccttcgataaaattcaacagcccttcatcctaaaaactcgcaataaactaggtattgatgggacgtatctcaaaataataagagctatttatgacaaaaccatagccaatatcatactgaataggcaaaaactggaagcattccctttgaaaaccagcacaagacaaggatgccctctcttaccacttgtattctgcatagggttggaagttctggccagggcaataggcaagagaaagaaataaagggtattcaaataggaaaagaggaagtcaaattgtccctgtttgcagatgacatgattgtatatttagaaaaccccatcgtctcggccccaaatctccttaagctgataagcaactttagcaaagtctcaggatacaaaatcaatgtgcaaaaatcacaagcattcctatacaccaataacagacaaacggacagctaaatcatgagtgaactcccattcacaactactacaaagagaataaaatatcttggaatacaacttacaagggatgtgaaggacctcttcaaggacaactacaaaccactgctcaatgaaataaaagaggacacaaacaaatggaagaacattccatgctcatggataggaagaatcaatatcatgaaaatrgccatactgcccaaggtaatttatagattcaatgccatccccatcaagctaccaatgactttcttcacagaattggaaaatattactttaaagttcatttggaatcaaaaaagagcccacatagccaagacaatcccaagccaaaagaacaaagttggaggcatcatgctacctgacttcgaactaaactagaaggctacagtaaccaaaacagcatggtactggtacaaaaacagatatatagaacagaatagaggcctccgaaataacaccacacatctacagccatctgatctttaacaaacctgacaaaaacaagcaatggggaaagggttccctatttaataaatggtgctgggaaaactggctagttatatgtagaaagctgaaactggatcccttccttacaccttatagaaaaattaactcacagtggattaaagacttaaatgttagacctaaaaccgtaaaaaccctagaagaaaacctaggcaataccattcaggacataggcatgggtaaagacttcatgatgaaaacaccaaaagcaatggcaacaaaagccaaaattgacaaatgggatctaattaaactaaagagcttctgcacagcaaaagaaactatcatcagagtgaacaggcaacctacagaatgggagaaaatttttgcaatctacccatccgacaaagggctaatatccagaatctacaaagaacttaaacaaatttacaagaaaaaaacaaccccatcaaaacgtgggcaaaggatatgaacagacacttctcaaaagaagatatttatgcaggcaacagacatatgaagaaatactcatcgtcactgctcattagagaaatgcaaatcaaaaccacagtgagataccatctcacgcctgttagaatggcaatcatgaaaaagtcaggaaacaatagatgctgtagaggatgtggagaaataggaatgcttttacactgttggtgggagtgtaaattagttcaaccattgtggaagacagtgtggcaattcctcaaggatctagaactagaaatacgatttgacccagcgatcccattactgggtatatacccaaaggattataaatcattctaatataaagacacattcacatgtatatttattgtggcactattcacaatagcaaagacttggaactaacccacatgtccatcaatgatagactggattaagaaaatgtggcacatatacaccatggaatactatgcagccataaaaagggatgagttcatgtcctttgcagcgacatgggtgaagctggaaaccatcattctcagcaaactatcaaaaggacagaaaacctaacactgcatgttcccagtcataggtgggaattggacaatgagaacaaatggacacagggtggggaatgtcacacactggggcctgttggggggtgggggtctgggggagggatatgtaaatgacaagctgatgggtgcagcaaaccaacatggcacatgtatacctatttaacaaacctgcatgttgtgcacatgcaccctacaacttaaaagtataatttaaaaaaaagaaaaaaggtattccttgcaatgtagtttgtgataatgaaaatctagacatagtttaatgtcttataattagaaattagttaaatatattatggtatagtcatgcaatggaatactatggaactataaaaaatgatgatgtagtgctgtatttattgatattgcaggaggtccacaatatgtcatgaaatgaacaaaagtagattccaaacactttatataggccaggcgtggtggctcatgcctgtattctcagcactttgggaggcgtaggtgggtggatcacatgaggccaggagtttgagaccagcctggccaacatggtgaaaccccatctctactaaaaatacaaaaaattagccgggtgtgatggtacacacctgtaatcccagctactcagaaggttaaggcaggagaatcgcttgaacccaggaggtggaggttgcagtgagccgagatcgtgctactgcactccagcctgggcaacagagcgagactccgtctgcaaaaaaataagaaaacccaaaaccaaaccaaaacagaacaaaagcagtatatatagtatgattacaagtgcatgtatatatttatacataaatttatgtataagtatgtgtatatatgtatttaaataagtatatgtataaatatatacatatataacatatgtgtatgtatatttatttaagcacatatataaatgtatacatacacatataaatatactttaagcatttatgtatattgattgaaaaaagtacatggagaaaaatacaaaagtgttcatggtagttatttttaagtgatataatattgccattttttactcattttatgactttttttttttttgagacacagtctcactctgtcacccagtctggagtgcagtggcacgatctcagctcattgcaacctccacctcccggatttcaagcagttctcctgcctcagcctccccagtagctgggactacaggcgtgctgccatgcctaactaatttttgtatttttagcagagaaggggtttcatcatgttggccaggcttgtctccaacttctgacttcagcatcccaaaatgctggaattacaggcgttagccaccacgcccagctgtactttgtaacatttttgataccaactttatttttcataataaggatatgttacttctagaatcagaagaagaaacctctttgttttaaaaaacttcacccaaaaagtcatccattcaagagttgtttttctccaccccagctgaygtgacaaaatgctgccaacaattttgatgccaataatgacttctacatattaaatacttctacatactgacaaaaaattatctcttaacagcatgaattgaattttataaaaaaaaaaattygattgggaatatctgctccagtacttagaggtttaactagtagcaaaccactggtttattttggagtgaatcaatctacattgattctatggaaagagtcctaaatctctctcctgtcaaaggaaatatttggcatgaaaaaaggcagcttgtatatttgcttgacagcatgttgtggtttaatgaattagaaccataatttttagctttgttcttaaaaacagactgattttagagaaatagaaataaaatgtatggaggtgatagaaaatacaaatttcccaggtactaaaggagggcctgttttactccttgttttaaatccctcctgagtgccaaatcttaactaccaattgcctgatgcttatctccacatgaacagctacacaggcaccttaactcatttacaaaattgaatgtgtcatctycttcctacaaatcttccatttcttcctcagttctacaacatatatctaagagcaaaaaccatccttcccaacacccggattaaaataacctctaagtctggatgaaaagaatggaggratgggaataggatagaagggatgaggggggaatggcatttttgtgacttttataaccatagtcacaaccattttgtgacatttataaccatatcaatgtttcatacattcaataaataaaaccaacaggatgggtggggagaggggacctgaaatggaatactaactataacaaatgaacctaaccatattacgaatgaataacaaccgcactgaagggtgtggagaagaaaaagaacaaatctcaataactctggaaaataatattttcactacatgctgtatggctaaaagacaaaaagctgtgcacaaatagaaatgcacatgactaaaactgtatacaaagaattatatacaaatattgtactttagctagtaagtttatttttcacaggggtatgaaatggcaattctgcatctactttatatatatatattataggattgagcaaactaatttagattttaaaagacaaagaaggtctgtaaataattcccgagagccagggatctcactgttggagaaaaaaagtcaaaaatgaataaataaaaggaaagggagaagggtagaatgaatcttgtgatatataagctattaatttgaactacaaattaaactgtaaattgtatgtatatatagagagggtggtagggtggtgtgatgatggtggtggtagcggggtttggtggtggtggtagtgggtggtggtggtggtagggtggtggtaggggagcagtagtggtggtggtgtgtgcgtgtctgtgcatacttaggatatgtttcctaaatctgtatgcagagagggcctggaatcaacactactgtaccaacgagcatgcctagcaaccaggtcttatttctaaatatcattctctcattaaaaagaaccagggctctttggaaagtgcttgataccagggcaggggaaagaaatgtaaaagatgggtctgtaacattgtgtggtgttgagaagtaagaaggtgctcaaaaacagatggggacatgttgacaggatacaggagccacctgagggaactcccagtagtaaaattgggcataatttaaacaaaataatacataaggagagtaatggaccatactctatagaataaaataagtttccatgagttcactgatacaaacaattgaataaataataaataaataagtggtggaagaggggaacatgctctcttttttttaacagtagaattctaattcacaaatakagaagaagtgacggaaatagaaaaatatcgagtgcagtggctcacgcctgtaatcccagcactttgggaggttgaggcgggtggatcacttgaggtcaggagtttgagaccagcctggctaacatggcgaaaccctgcctccactaaaaatacaaaaattagccgggcatggtggcgggtgcctgtaatcccagctactcgggaggctgaggcaggagaatcgcttgaacctgggaggtgaaggttgcagtgagccgagatcaagattgtgttactgcacttcagcctgggtgacagagcaagactctgtctaaaaaaaaggaaatagaaaaatatcatttggcaaacatcacattaataattgtttcaatcaagaatcactaatggctactaacatcatgctaacacatgatgagaaacaggatatttacatagccttgaatatgtcccctcaagatagtcacagattataaacggaaaaatagaaacttttcagtggagaaacctagcagatagcatcttaaccaaatgacagaagttatcattaccagtagtgagatgttccagcaccatatgtctcctaatacatgtactgagaaaggcacaacatcttctcttgggaggacataattctgccaaaaatgcacagtctgaatttaatcatgaggaaacataggcagtctacagaatgactgactagtaatcttcaaaaatagcagggacatgaaagacaaagcaaggctcaagaactatcccagacaaaggagactgagaaaccatgacgactaaatgcaacgcgggatcatggatcagaaaaaaagacatcagtgggacaatgtctttggggatagctgaaggtcgataggtaatttttgrtgttacttctcactttttatacacctgaaattattctgaagtgaagagtaataaaaactttagacatttggtctggtgccgtggctcatgcctgtagtcccagcactttgggaagccgaggtgggcagatcaagaggtcaggagttcgagaccagcagggccaatgtggcgaaaccccgtctctactaaagatacaaaaaattaaccgggcatggtggcgggcacctgtagtcccagctactcgggaggctcaggcaggagaattgcttgaacccgggaggtggaggttgcagtgagccaagattgcgccattgcactccatcctggaccacagggtgagactctgtctcaaaacaaaacaaaacaacaacaaaaaataaactttagaaattagttttttaaaaaaaacatcaattcrcagactggtacactgtgctgagggaatgacgagaacaaagagatgaggagtggaagcttgggaaggctgggcacaggtggggccttcgggggatggccctgggaagcagggctcggggcagaaatgaagggggttgcatgtcacaatggagagcaaaattttaacagctacaaaattggaccctcatataaagtggtggattccccttcattcccctctccctccatattatgaggaggattttcttcctttaaataataaaaattactatcttactaatttattttcatttgtgtaatatgacaaacccaaaagaatgtgctgctacataatttaaaataacataaagaaaatgcattttagaatgaagcagttataggagaaaaccaaacctaaaacaaacacaatctgaatcattttgattctgcattctcctctctgccggccttgcttttcctgcctcccccaccctattctcccttattccatctgtcaccaagccctgccaattataacttcacactatttcttacactaggattcaaatctaaaggcctcaggtttcatctttcctctgtacttactagccctactactgtggacgattctctctgtgcctgaatttctctctctctttctctctgtttctctctctctttttctgtgtgtgtgtgtgtgtttgaggggaaggtaggagtccagtaagataatgcacatgccctttataaacaataatctattatgaaatgctaaggtttatttggggctttaatgtgtattatctcgatgagtggtttccaaattttatgattttatgaaactaaaaagtttgattaactgatagaattttcaacttgataaaataaaaaaaatctccttactataccatttcatatgaataaaagaaaggacattttaacaaaaaaaggacatattctcagaaaaaaggtctttcccaaccttgcattgtgttacatttctatacccatggttctttctttttctccttttaagcagactgaccctatgccatcaatggttctagggtcagcatttaggaattgtcctggactaaaatgtccgaagtgataacttcctgagctccttgtatccaatcttgccttcttttccagtccaccctatgctcggcatccaacaattttttgttaaatgaatcaatggacagatactcattttgaaaccaatgaagaattgagcctgattattttggagttaattaaagtgaggagatataggagacagatgagccagcatattcatacttggatatagagaggagagctgagaatctatttaccacttcttttctcttacattttctgatttactgttcagtgattttacctaagttgagggtgtgtctttaaagtagcagaaccttgctggaataataaatacataaatggaagtgctcctcaggggcagaggggtttaatttattctgcaggcagtggaggtggtggtttagcatatgagtctctttcttttgccaagcaccacttggcaaatccacagaaggattgacgttctttgtctgctaaaacctggggagagagaaatggagcagacaccctcccatgggaccccccaacttttcatcgctgtgtttactctatacatctatatgaaattatttactgaaggctaagggtaatttcaaaaataacttacaatatgggagggacaagtgttgaagtttaagccctcttggactttccctgcatcagaagccaaggcctgcagatgcattgtccattttggacttggcttttcagcccttatagttgcatctgcaccttatactccctctgtcctcacaagcacctggggcttcaagtatcttagtccaggaactttagcccctcttgagaaccttcagctcctctgcatgagagcagatctagaatagaataaacaccctgggcttcagctctgagtgggcaaggatacttgctgttcattgctgtcctgtctcgtgtgcctgtatgagctcgtgtgtgtgtatgtkcgtgtgtgtgtgcacgcatgtgtacatgttgagggatctgaaaatcgggtagtggatgggctccagacccttgagtatggtttactgtgtgccttctagtttgaactcaatcttcccataggtaagaatgatgaggctgttggcttctttattagttgactcaaatgaccacatttttcaaagttagacattaatttttctttaataaatcatagtttaaacttgggttgctattttctctactagcgtagttctggtttggcctttagaaacaacagtccccggccgggtgcagtggctcacacctgtaatcccagcactttgggaggccgaggcaggcggatcaagaagtacctttatttctttattaaagnatcttgattcaaaaggtttccctcttaccaaaaagggatagggaaagttgccagttaaattttccatcctaatagtaatgttgctgtgagagaaggagattttggagaaataggtaactgatttcaaacacatgatgctttagggctatttatttatttttgcttaaaggtctttgttgtaaaaacagaagtaagatctgacggtcctaagaacaggatgccactgcttccatacctagtgtggataggaccttttttcttcttttattatccttcctacctgttgaaagactgttgtcagtcagagctgaaacccagrttggccctgagctcaaatcatagtcaagtatggtagtcttaagaatgggagagtcagctgggtgtggtgggttatgcctgttatcccaggactttgggaggtcacggcgggtagatcacctgaggtcgggagtttgagaccagcgtgaccaacatggagaaaccccatctctattaaaaatacaaaattagctgggcgtggtggcccatgcctgtaatcccagctactcggtaggctgcggcaggagaattgcttgaacccaggaggcggaggttgcggtgagccaagatcacaccattgcactccagcctgggcagcaagagcaaaattccatctcaaaaacaaacaaacaaacaaaagaataggagagtctgggtgcagtggctcacgcctgtaatctcagcactttgggaggccaaggcaggcggatcacttgaggtcaggagtttgagaccagcctggccaacatggtgaaaccccatctctaccaaaaatacacacgcacacaaaaaacgaattagcaaggcatggtggtgcatgcctgtaatgctagctacttggtggctggtggctgagcgtgagaatcacttgaagctgggaggttgaggttgcagtaagccaagattgttctactgcactctagcctgggcgacagggcaagactctgtctcaataacaacaacagaaaaagaatgggagaaatatacctaacaataaacctgcagattattaattctatgagtgttgaagtcaagaatgagttcagactgaatgtgatgtaactctggttctgcttttctttgctttctccatggcacttattcaggataggcacttcagaagacattcctatttactggctgggaggccaaaagctaagacagaactttcagtctcactcttaggggtcacaaaattattgctttccaatttaaactgtttcacttccaaatttgagcccccaaatatgaaatactgcctcacctgtgccttttatgctgaaaatataaaatattttaggaaaagaaacacattttaaatattaatatctgctaagtaattttgttattaatttagtttttgagcagagttacatttgaaaaaatatataaaagtttgaatatggatagagagatagatagagtcattccaggttatttaactgttgactctttaagtgctgcatttaagtacatacttgaatcattggaaggcatttttgacttttcagtgttttccccagcacttttccatgggtttaactgagtgctgggttgttgagtcttaaattgtacattaaaaattaggtgtccaacaaatataagaaaattatgtggttatccacttatggttaagaaataaatatataaaatgtcatcactaagacattttatgtatttagcctctagcctctcaaaggcataactactaaagcatatttttctgccttaatattttgtaactccattagggttaatggatgttctaaacaaccttaagctatttggaagagtgccttatataacaatgttgtttatcttccacagaataaacactcgaaaggcctagtacttctctccctaagccagtgcattctggaaagaactcagtcataagagtccattattcaaataaaatgactgttgaagcagaaagtaataactgattttttaaagaagatcgttttctaagatttctaaaattgtcaaaaaccattttaagttactgcaggtgcatttattctatgagttgngttataaatcaaaagatttcctattaacctattttaggaatagacttgtaattctcaaacttgagtaatgtaatgtaaaaaagcccttaaaaggaagaaaatatttagattattagaatacccagagttgatgtatatgatttttatgtcattgttattgctatgtctttctatgtttatagctaatatgtccacgtaaaagctaagtttgtatatatttatagctaagatatccacataaaagccaaatacatttacatattaaatacaagccaaatgataaaaactaatataattaaaattgacaacattaatttgctagatgatgctttgctgaaattgaagagcatatgttgaggttaatgataggaagatttagtcacttacttttttacatgattttttttttagtgcaatagattatcatgtgaatcactgtcatcatatttatttatattttaaaaatgattttgtttttatccactacaatttattggtgggccaatttaattgttcactccaaaatgcaagagagaaaatctgactggaaaatccttcattgtatatttattttaatagatactacttgcatactgttgtaatttggcacatacagagacagaatcagaacaatacttccacttgtgataccagtaaagcactggctggataaccagggcagcctcacttatgtctttttcaattaattaattaattaattactttttttgagatgaattctccctctgttgcccaggctggagtgcagtggcaccatctcggctcactgcaaactctgcctccctggttcaaatgattctcctgcctcagcctcccaagtagctgtgattacaggcacccgccaccatgcccagctagttttgtttgtttgtttctgtttttgtatttttagtaaagatggggtttcaccatggtggccaggctggtctcgaactcgtgacctcaagtggtctgcctgcctaggcctcccaaagtgctgggattacaagcctgagcctttgcaccccgcccacttctgtctttataattgttgggggaaaaacatccaaattgaaagcaataatgatgcaggatgatggttgatatttttactttataacccacaatctttgatcagctagctatctatgcttaccagtacattttaaggcaagctgtgtcatttcagatgctcatatgtgtcaccaatcccattggggtcacatgagaggctggcatatggyacaatttgaaaataacacagtcatccagacaacccaggatatgctttttatgaaacttataaaaatggatggaaaaaaatggaaaaaataaaaaggaaattataataaaatgaagggaccccagagaatcaattggttgcagaaatcctgggttaaatcatacaaatgaaattgctttgaaaactgtagcatgctttacaagtgccaatactgtattattatgaaacaaatataattggaaagatctggacttactagacaataaaaaagattggattaactctacatgcagacagaaaattcccacagtgaaggtcattaatcagagtttgtagaaaaacagctgctcctgccattccantggagaaagcacaaaacaacataattgcttcataactgtactctggggaagactgaccttggttctaagagttgcttgtgtggcctggttctgtgtgtgggttaggtgaggaggaggaggtgttgagtggggaggggaaaggaccccttccctctgaaagaaactgaagcatttgatctggggctgttccctggggcattgtggggcagagacccctggaaagaaagcagtaggtgagatgcctaggtgagaagtagaagtagatgagaagtctagggtggagtcccaagtacatactcgactactcctagggcactgaccctaaaataattaacctcgtaggaaaaaatcatgttccctatagaaacataaagtttttactacttggcccctaagtgatagattatatgttgttgctcaaagagaagaaaatgcagatgaagtaattccacatgcatcaggaaagtccctttcctctctgtactcaagatagctctcaacattgatcttcaagtattgattagtcagagaaaggaagatttattattattctctaatttccactttctgaaatgttaatattgttttcttactgagaatgtgaacttttggatgtgattatcagctaatccagttggaattcaatcttggcattataacaggatcatatttacaacctacttcagtttccaaaaatcagccaactgagagaaaatattgtgatcaggaatttcaatgggaaagccaaaatctagagtgaaaacacatcttctgtgaaggattacatcataaagtgtatgcgagcctatctggaattagggataagtacagagaagttcagttcagttcagccgacagctttggagtgtctggtctatgtcagggactatggtagaggcaggggtgcagaaatgggcaagatagtctgcttggtctcaaggagctcatgatcaaataatcagtctcatgttaaaaactgaaatattcagaatcgtttcagctcaaacagagagcaactgatgttgccaggatcgagatggattcatgtgaaataactacgtcattttagaacagaacattgaaaagtgccatcaattatagagcataaagtgaaattgtaattgaaagtagtttctttgttacttagattcttttattaggctcctttgttcaaatcaattctttcttttaaacacaaataagatgattctgggtagatggatcttcaagtagattttagtccagcttaaatttaaatagggaaagaacaatcagggatattctactaaattgttaggcaccgaattgtgttatgttcttactaaaaataggtatttcttataatcttcagatgctctaagctggcatgaataactagtactgtaataaaataagttctgccaaaaagttaatctgacacacagcaatgaaatgcctaaagctgtgtgtcatagagtcattatccataaatgataaatgatgctcataaataccagtattgaaaattatttccccatggctaaaccaaggtcagatttttttcttgcactcttttttagtcctctatatccatagatagcacccaagagtgaacagttttgctgaatactatgttcagggtgagattcatttcacttcgtacccccactaacctcacttaccatatggataaacttgaagcaaagatattggattaaaccccatatggttcctatcctgtgtgtctcttccttccatcccagggccagactcagctccaaactatggtacccaagtgagagggccagactagtgcatccaaatgcttcccactaccatctctcagatgcatctaggatgttgtgaagctccaggtaggatgaattctgtctgggaggttcaggtgactcccgaccatgtcattatagcaagagacgaaattcactgtcaagttatggtaagaacttaggtgagggtgctgactcagtaaaaaggacctttgcatcctggcaccagagagattcagagacaagggagacagataaggaagaggaactgtattgtcagggttcgctcccttcccagatctatgcacaggagtgtcaggggacctaacaagtatatttgctgtggaggaaacttccccactgagccatcagcagtccgygtcctgaaacctcagcctctattacaatattagatctgtcttgggtctaatagggagagaaaagagagggccaaaggtccccacctgtgcatcttctttcttctccccagagttaaccactatcttgaatttgatcatttcccactgacagtatgtactccagtatgtattattccactttcaaaaaaacttttataaaaatgctgaatagtaccagtcatggttcaacaaggaacagatggcatactcaaaataggctaatttggccaggcgtagtggctcatgcctgtaatcccagcactttgggagaccaaggcaggtggatcacgaggtcaggagttcgagaccagcctagccaacatggtgaaaccctctctctactaaaaatacaaaaattagcttggcgtggtggcatgtgcctgtagtcccagctactcgggaagctgaggcaggagaatcacttgaactcaggaggcacaggttgcagtgagccgagatcaagattgtgttactgcattccaatctttccagtctgggtgacagaacaagattctgtctcaaaaaataaaaaaaaaataaaaaaataaatgctaattcaaggatggtttttttttttggagacggagtcttgctctgttgcccaggctggagtgcagtggcacaatctcggctcactgcaagctctgcttcctgggttcacgccattctcctgcctcagcctcctgagtagctgggactataggcacccgccaccacrcctggctaattttttgtatttttagtagagatggggtttcaccgtggtctcgatctgacctcatgatccgcccacctcggcctcccaaagtgctgggattacaggcgtgagccactgcgcctggccaaggatggttttttttgcagagattatttacaaaggtgtgggagtagggaaccacaatggatagatagggcaattaatcagggcttactcgaagtcaatatgttactgtctctaggtctgaaaggtagaggaaaaggagctgttaccagacccaaagtgagagggtcctttagagtctgttgccaccttgagagaagcaatgacaggttgagggacacaggtggccttgcagggaggggataaatacattgatctcactttcttctcttcttcctatttccttttggggcttttaattgacctaacctaactggaagcagaaagcacagaaatctgtttatatggtccattcatttaagaacacagagcaggggagggggctagagtggttttaggtgatggggtgggaaaaggaaaatatccagcatatacagtattgtcctatgacttgcttttttagttaacattatatttatgtgattcatccatgtcgatatgcttactgtaattgtagtagttcattcatttttcacttaaaaaattccattgtatgaatacaccagaatttatttatctatttctttttctttttttctctctttttttttttgagacaaggtcttgctgtgtctcccagcaggagtgcagtggcaggatcatggctcatggcagcctcccagcctcaggtgatcctcccacctcagcccccagagtagctgggactacaggctcgtgccaccatatctggctaatttttgtattttttgtagaggcagggtttcaccgtgttgctcaggctggtctcaaactcctgggctccagtgttccaccctcctcagcctcccatagtgttgggattacaggtgtgagccactgtgcctggcccagtttatccatttctgatgatggatggtttccagtgtttgagtattttgatattgccacgaatgttcttgttcatgttttttgatgtctacgctcaaaactttctctagagaatatacctagactagaatcacatagtgggataaagagtcatatgttttcaaatttaccaggtaatgccacatttttcaaagtagttgtatcaattaacagttttacttatagtacacgagttcctagtcaacacgcaatattttcaaactttgaaacttttgtccatctggcacctgtagaatattatctcattgtggttttaatttgcatttcttcaattactaatgtaattaaacatatttacatatgtttatttatcatttacatttccttcattgtgaaatacttgttcaggttccctttctcttttctactgtttattttattttatttttcttttttttaattttactttaagttctgagatacatgtgcagaatgtgcagtttttttgtttgtttatttttttttttagtatttattgatcattcttgggtgtttctcagagagggggatgtggcagggtcataggataatagtggagagaaggtcagcagataaacacgagaacaaaggtctctggttttcctaggcagaggtccctgcggccttcggccctgtttgtgtccctgggtacttgagattagggagtggtgatgactctttttttttttttattatactttaagttttagggtacatgtacacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcaatagtttactgagaatgatgatttccaatttcatccatatccctacaaaggacatgaactcatcattttttatggctgcatagtattccatggtgtatatgtgccacattttcttaatccagtctatcacacattttcttaatccagtctatcattgttggacatttgggttggttccaagtctttgctattgtgaataatgctgcaataaacatacgtgtgcatgtgtctttacagcagcatgatttatagtcctttgggtatatacccagtaatgggatggctgggtcaaatggtatttctagttctagatccctgaggaatcgccacactgacttccacaatggttgaactagtttacagtcccactaacagtgtaaaagtgttcctatttctccacatcctctctagcacctgttgtttcctgactttttaatgattgccattctaactggtgtgagatggtatctcattatggacttcacgtccaaaacaccaaaagcaatggcaacaaaagacaaaattgacaaatgggatctaattaaactaaagagcttctgcatagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggtcatcagagaaatgcaaatcaaaaccacaatgtggtgatgactcttaacaagcatgctgccttcaagcatctgtttaacaaagcacatcttgcacygcccttaatccatttaaccctgagttgacacagcacatgtttcagagagcagggggttgagggtaaggttatagattaacagcatcccaaggcagaagaatttttcttagtacagaacaaaatggagtctcctatgtctacttctttctacacagacacggtaacaatctgatctctctttcttttccccgcatttctcccttttcttttcgacaaaaccaccatcgtcatcatggcccgttctggatgattgctrtctctttggagctgttgggtacacttcccagatggggcggccgggcagaggcgttcctcacatcccagacggggtggcggccgggcagaggcgctcctcacctcccagacggggcggccaggcagagacacccctcacctcccagatggggtggccgggcagaggcgcccacttcccagacggggtggccaggcagaggcgctccccacctcccagacaaagagcggccaggcagaggcgcccctcactttccaggcagggcagccgggcagagactcccctcacctcccagacagggcagcagctgggcagaggcgctcctcacttcccagacggggtggcggccgggcagagacacccctcgcctcccaaacggggaggggccgggcagaggcgctccccacctcccagacgaagggcggccgggcagagacgcccctcacttcctagtctaggcggccgggcagagacacccgtcacctcccagacagggtggcggccgggcagaggtgcccctcacttcccagacggggtggtggccgggcagagatgcccctcacctcccagacggggcggccgtgcagaggcgcccctcacctcccggacggggcggccgggcagaggcgcccctcacctcccagacggggcggccgggcagaggcgctcctcacctcccggacggggcatccgggcagaggcgctcctcacttcccagacggggcggccgggcagaggcgctcctcactttccattcagggcaaccaggcagaggcgctcctcacttcctcccagacggggcggcggggcagaggcactcctcacttcccagagggggcggccaggcagaggtgctcttcacttcccattcggggcagccgggcagaggtgctcctcacttcctcccagactgggcggccgggcagaggcgcttctcacgtcccagacaatgggcggccaggcagagacgttcctcacttcctagagggggcggcggggcagaggggctccttacatcccagacgatgggtggccaggcagagacgctgctcacttcctagacggggtgaccggcgggcagaggctgtaatcttagcattttgggaggccaaggcaggccgctgggaggtggaagttgtagcgagccgagatcaagccactgcactccagcctgggcaacattgagcattgagtgagcgagactccgtctgcaatcccagcacctcgggaggcggaggcgggcagatcatccgaggccaggagctggagaccagcccggtcaacacggcgaaaccccgtctccaccaaaaatacaaaaaccagtcaggagtggcggcgcgtgcctggcaggccgaggcgggagaatcaccggagcccgaggcagggaggttgcagcgagccgagatcatggcggtacagtccaggctccgcaagaaagggagaccgtagaaaggggagaggggagaggggagacgggagaggggagaggggagaggggagaggggagaggggggagagggcttttctactgttttttatttttttcttattatcttgatactaacaatgaccctgtgttaattttatcatctcgcaatttgtggatatctaaaaaactgtgtatttatgtactttaaaaagttttatgtacttttaaaaaggtcaagtgtggtggcttatgcctgtaatcttagcactttgggaggccgaggcaggaggattgcttgagtccagaagttcaagaccagcctgagcaacatagtgcagccccatctctacaaaaaaatttaaaaatcagccagtcttggtggcatgtgcctgcagtcctagctatttgggaggctcagctgggaggatcgcttgagtccaggaggtggaggctgcagtgggcagtgatagcatcactgcactccagcctgggcaacaggaaaccctgtcttraaaaaacaaatgaacagaaactccctccccatgcaaaatcccttaagttcttaatttaatgtagttaaaatgatcaatctttctctttttagcttgtttttttaaaaaaagtttaaaatatacataacacaaaatttaccattttaaccatttgtaagtgtacagttcagtggcattaactacgttcacattattgtgcaactatcaccattatccatctccagaactgcttatgctttttcttaatgtcttgttaaataaattctttggaccatcaagaccataaagaccgtctatatatttgttttaaattcttaaaattttgcctttcatatacaagttcttaaatcatctggaattgattttttwtatagtaggaggtagggaatacatttttcctccctatagacagccaattgtcccagcaccatttagaattgtctatttttttcttccattgatttgtacggtggatctgtcatatactaagtttcctcataggtgtgggaccatgtttgggttttctattctgttccattgattgatgactttattcttgtaccaatattgtaatgtcttaaatactaatgaattaagattagccttccatctgcctgaaatgctattctcctaaagatagacatgactaaatcccaagttttcttctggtctctgtttcatggccacattcttagccagcctttcctggctatcttttctaaaatttcattatctccttgaaaaactttacattcttcttttctgattaatttctttctgtttagtagttgttatctaacataattatttatgtctttaacttgtttattgtctctcttccccattagaagatttataagagcaggattttttggctctctcatcattctcatatccccagcatagaaaatgttgcctggcacttagtaagtgtttaattactatttctggaacacaccaaataatgctgatatatggaagggtagtgtttcttcaccgtgctaccattaagaatgtgctttctgtcagttctcctgctccttgattttgactaataaagcaatctaaagcaaatggagagagaatgaagtgctttctttaggttgtttcccagccaactccgagaggtaggcagtgaaatggggagggtggagggccagaggttggctaactctgcattagcttttatgggtcagctatcttgctggaaatacctcatgttctctgcttttcatggcaaacacagctggtaggacctagaatttacagcatgcttactcagtaaagaagcttaccacgcctttggttttcagggcgacacaccccgctcagaagaggaatgaacactcacttagatttaccaagcatggcaactaaattctcagctgtaagtgtgacactttttgggatagaagttctggagctgtggaggagttatctcagggtgaatgccacgtggggcagtctgtctgtagctgggtaatgcccaaggcaggcactgaattgagcagtgatgattcatggaaattctgccagagaaggtactctgtgctttattacaggctaaactaggaagccaactcattctggaaggaatgtgtataatgttttcagatgaggacttgaagttttataggttggagtcacatttgattcaaaccatctgtttaatgggaagctgaacccagcattttttttcatatgtctctcacagtattcaacaattcagtatgggctgggcgcagtggctcacgcctataatcccagcacttagggaggccgaggcaggtggatcacctgaggtcaggagtctgagaccagcctggccaacgtggtgaaaccccgtctctactaaaaaagcaaaaaaatagctgggcatggtggcaggcgcctgtaatcccagctactcgggaggctgaggtaggagaattgcctgaacccaggagttggaggttgcaatgagccgagatcatgctactgcactccagcctgggcaacagagcgagacttcgtctcaaaaaacaaaacaaaaccaaagaaaaaacaaaaacaattcagtttcataagtatttattgagggcccatggagtgccaggcactggggtcacagaaatgaatgaaacagtcatccctgtttttgagatgctatggttcagtggaagtaaaacttacatgtttatgtatgttttccttcccatgattgtgaggtcaatgtctgtatttacaagaatcttggttgccagggctgagcattgtgtcaatcaattttttgtagatgaagtgaatacatgaaagagctcacagtgatttactgaacatggctgctgaaatgtataacattattgtgcattattgctaccgtgatatgcggatttatattgcaattgcctctggattcagaaaaacacccttcacagtgaggtagtgaccaaaactgtggcattaggaaacaataaaaatgctggaatagctgaccaacacagggtattttgttccccggggcttaaaatcagtttttaatatgatgaaaaggcagctattatgtgacatagtaagatattggtatgttaagcatgaacatatatttccagttttctctgagctggtcatgaaatgacactggctacttcgtcttttaattgggcagatattgtaggaagtactttggggatcacagagatgaacaaaagggctcatccaaagaaagcttaaaacctagtagtgctggaattcttaactagccacatatggtgatcttgaacctcttgaaatagtatagatgtgtgtgtaggtgcatttttctgaagagagctttcatcacattgtccagtggttcatagacctaattaacatccctctactacagaagttcttaatcttgatcttccaaaagataaagaacttctgtagtagagggctataattatttaaagaactacaccatatgggagtcatgaagagcctcaggggtttaaatgaggagcaaaacaggtggcaacactgagtagtttcattataaaatccttgacaattttgcaggagaaaatttctttgcctctagtgataaaaacatttttcatatttaacagtagttattttttctatgagttacctcttcttcttcttgtcctatttttctgtttgtgtcttaggatttttttcctaatgagttaacttctttgtatcctgatggcattaaccttttcgatgttatacttttggtagacctttctctagtttgatgagtgcaaaatacttctgtgaattttttacatgcataattttataytttttatggtcaagtctttatatcttttttctttgtaatttataatatttaaatttgtttgctatccagagataagatattcatgtaaatattcttatggtctgtgrtgcaggttttttcaggcagtttatatgctttcaggtgtcttctttggaccacgtgatgtatttgtattacgtatttgtattatgtatttaatacagagaggaagaaatgaggtgaagctctgctgtcatattactggaattggtgtagtgagatcgttagcacagtggggcctggagagtttctctgggtttgaacatggctctgacattttgtgtccttttgacttcatttaacttctctgttcttcagtttccgtatctagaaaatacgtttaatataataacctttgggaggccgaggtgggcggatcacgaggtcaggagttcgagaccagcttgccaacatggtgaaaccccntctttactaaaaatacaaaaattagccaggcgcctgtaatcccagctatttgggaggctgaggcaggagaatcgcttgaatcccggaggcggaggttgcagtgagccargatcgctccactgcactccagcctgggcgacagaacaagactctgtctcgggtattggtggtgggtcggggggaataacctatcttatgtggttatgataataaaatgagttgatatgtaaaccacttagaacaggtcctgatataaagtcagtgccagccacagtttagtccaggctgggtagatgctttgaagcttgatattgtttcaatgtactttgcatttctaaaaacgtgaacatttcaaagcattcatttgatctcctaaggactacctataccggagcctcattccagcacatttgtaagcgaggcacgcctcctagargccacgagtgaagttaatttccagttctcgaaaatcttacagacagcggagaactggtgtggtggctctgacgccccgcttgtgagtctgcagtcggacatctggaaagtaagcggcacgtccgcgtgatttccagtgcttcatcttcttccaccctaccttccctccgaggctgggttcttctaattcctgtagattgcagagcgattcctgcgaatgtgccttctttcattcattctagttcattccacagataattcagctgcgcgcttcctctgtgcgaggcattgccggagagcggggagcgaattgaacgtggaacctgccagtaggggcttgccgcccaatacgaaattcaanatatgtattgtatgtagacgggcaaactaacgaggatcttgtaacttgttttctcatctgccaaatgggggtaatacgatcttataggaccttataggtcgctgaaagattaaacgagcggaaaaaaaagagcccctaatagtgagctaggtgcaaaaaagatcctaatgccttttttcctcattcctccccagattgaaagtgatgagtgccagccctgngggttaaagcgccatattttcctcaatatagggaatatttgttagtgtccccagacgaagttacattggttcaattttcggcgtgtgggagttttcgccactagcattcagcaccccagtttnaaccgttaaagctaccgactccacatacaggaaatgcatcttaaaatttggaaaaaaaatccccaaaacactgacatccaaacactttaaagctgccaaggtgganggaacaccttgaattcccagacgcgctccactgagcatgcccagagcctcaggccaaaccccctcctacccgccaaggggaggtggggcagggctggccttctgtgctagtcacttcctcttccggtttcatatgaactctcccgccacccgggaacagtggctgccaccgtttgtgttttcccgagtttgaattcttgcaggtaggggaaacttccgcgaatttaggacagagagcaatcctgttattaaggcttgcaagtcgagagaaaggagagatggatcactttgcaggcagcagtagcagaaggacagacttggcgggttggttgtttggggcagacacccaggtaccagggaggagttggggagagataggtttgccagtggagtgaggaggggtgttggggatggaacttttgtaaggcacttgtggatgctcccgaaaaggagttccgaaagacagttgctctgtttcccagagtcataacagaggaagtgagtaactggacccagtccatcaagtaagaccctcatttagccagaacctacagcactttcctctaagttcaggattgcagaccacgtaaaaccttatgttaactcttgggatcgtaaagatccaagaacagtgacacacaggcctataatgagcaggcaacatcacctgactttcatgttgctgaaaattaggatcaccacctgcatctgctctagcgcctctcccacccccattacaaaattattataggtgtattgtagaaaatctggaaacgagagaaggacatcacccaggaattgccactgctaacattttgtgcatgccctcaaatccattttttttctgtgtttgtggaattattttttcgtgttttttcttttttttcccccaactttgttttccatcattttacgctttttgtgtacttccttctaaggtgaccaagatggagttttctggaagaaagtggaggaagctgaggttggcaggtgaccagaggaatgcttcctaccctcattgccttcagttttacttgcagccaccttctgaaaacatatctttaatagaatttgaaaacttggctattgatagagttaaatgtaagtactatttaaattagaatgtatatattcttgagaagctcacttaccctttgtgagaatgaatgaaggtaattcatttccttcattcagcaatccattcaacaagtatttattgaggtaattcatatccttcattcagcaatccattcaacaaatatttgttgagggtttggtactcattcatttatttattgtacaatgcatattattgagtgccattatgttctaggtggcagggattttgagatgaataatgttattttttgttgaagttttattctagtacatggagacagacatccaaaataatagtcataattcagtattttaactrctctagtagaagtaaatggtagtgctgttgaaacaaagaagtgggagtgactgacttagtcttattaaatgagcttcttagagaagttgaaatgtgatctggacatactgaagaatgagtagaaattttccagcagagaagaagtgargagtttttccaagctgagataatggcctatgcaaaggcttggagcatgaaagagaatttcatatttgagctaacagtaacaagttcaggaattcagggtggatggagaagtatggagggcattttgtgccatgctaatgatatgatattggggtgtaagaaggatgtggccaccgtcctgggggcctacttaatcctcagtgtgttgctagagaaaagaatgggctagacntgaattgaaacagaaacactagcgttgtcttcagagtttatgttccaggatatccctgtggggaaatcagaaggaaaggtgagatactgttaatcattcttagaggagcagggtaagcactgctaatacagagaggaggcactcagtgcctgtgtgttgaatgaaagaatgaagacaagggagaaaagggttttagaaagcttagcagtgtcaatacttcatagggattaagatggtgattgaaaagtgtcccttgggtttggcacttgaggtgaaatgataagggcctgaactatgataatgacaatggcagtggtaggaagggagagagttaagggatactgaggagttagcattgataggatttggtgactggatatgaggagtgagggagcaggtgtggagtggctgcagttcctgcttggatgatctgatgcatggaaactctgctgctggagatgggcatggcaggacgaagagtaggaatgaggggaggataattaatttggatacccatacctgtgggacatggggtttatgttcaggagacaattagaagttcttcattcttgacttcaaaaatgcctccagagaataattcatctgaggaaagattgatatggtgctttaggaacctttgaacagtatgtagcatctgttcaggatggttcatttggctgtttggatggcctttcttcttcactgttgtgctctgtcctcggcttcatcaggaaaggaagggatgctttttttctgttgaatctargccaagtaaatgatgcctactgcctaacaggcagctcccatacgaaggatgcaaacaaggagtgcctagtttttttttccatactgacatacttttctgttcctcaggaatgattattcaccatccatccctcttccctgattgagaatccctggtattaaattatgctgtgggacatggatattttctgcacatagatggacattatcctcttataagcatatgtagtttatatgatgtcgttacaggaaataaactggcaattacctgtcatgttctgtaaacaagtaattatggaattgccctccatagattttgtcttggatttagttttaaaacattatcttgcatttataccttttttcttttttttagtgttaaaatcagttgaaaatcttggagtgagctatgtgaaaggaactgaacaataccagagtaagttggagagtgagcttcggaagctcaagttttcctacagagtaagtaaaaaaggaaaaaaaagttccttcagtttctatgcatttatgtattgagtgtcacttgtgggaaagatattatattaggcactgggcttttataaagactaatgtatcattagcctgaaggttcttcagtgtattaggggtgattgacatgaagtcagatgattataatatggcagggtttctcaacctcaggactaacatcattttgggtctgataattccttgttgcagggattgttctgtgcactgtaggatgctcagtagcatctctggcttctacccctacatatttccagacatgccaaatgtatcccgtgcaatacaggatgatgactgtgtttatagatgcatgctccaggaactccaaaaacatacataattatgcagctcagattggggaggtttgggaaggctttccagaagaggtagtagtggagctgcatgttgacagatgtgattagattttcattttgggaagatgactgccagcagcagattgacagggtcatgtctgttaggagggaaaccagttagaagcccggaaatgatgagagtctgaattaaatgagagaaggggaccggttgaagagacattaagaaggtagaatcaaaaggttttagtgactgattgtagggggaatggagagagaagagttataaatgacacccaggtttctagttaggaaaattagtggatggtggtaatattttgagatgtgatatgcaggaggagaagcaagtcttggaagacgtagagtttagttcttaacatgaatttgaggtgcctgtggagatgtctagtggacaattggatatacaggtctgaatatacaggaagacatgtggtgggagtagatttagcagaaggttggaatcatcaggagtaggtaagagcaccctagaaaaatatttgagtgagaagagatgacrgtggaagttaagacatgaggaataccaatattgaaggtaaagtggaattggaggaatttgggaaggagaatggaaaggagctttctcagaagtaggagatgaaccaggatagtagtgtcatagaagccaaggagggctagagtttcaataataatgatcatgatattaataatgataatagggaataacagcagatatttatattaatagtatgtttgctwtgtaccagattttgttctaagtgcattacatatattaacccatgtatgtaattcatacagcagtcttatgaggtgggtattattatcatccctattttacagatacagcctatttattcacagactgaataacttgcccaagctcataagatggtaaatggtggagccaagatttgaatctgggtattttgtttctgtagtggtgcttttaaccacaatagtttcagaagcttaagatagattatgtaagatgaattgtacagtgtccattggatttagcagctggatgggcccttatagataggggcagagaccagaacaatgacagtggttggagaaggaaggtggagcggtggatatagaagatgtacttttttaaaatgtgtagctgaaaagagaagagaaatagggcagaatataggggttgttttagggaaaagagaagatatacaagcacacacttgtacatatatgacaggagatacttaaacatgtttataagctgagcagaagatctagaatagaatggggaagaggggagcttgaagttgaaactttgagagagcatttgataagtcagggtctttaagaggcacaagcaaatgggttgtggggtttaggtgcaggaattagcttttcatatggtttggctgtgtccccacccaaatctcatcttgaattgtagttcccataatccccatgtgtcatgggagggacccggtgggaggtaattgaatcatgggggtggttacccccatgctgctrttctagatagtgagttctcacaagatctgatggttttataaggggcttttccctattttgctcagcacttctccttactgccaccatgtgaagaaggacgtgtttgtttccccttctgccatgattgtaagtttcctgagrtctccccagccctggggaactgtgagtcagttaaacctctttccttttatgggtttactcagtcttgggtatgtctttattagcagcatgagaatggactaatgtagctttacatgccaggaagaggagatgctttgtagagatgtatggaaggcaacacaacatgtgtatgcggaagcttgggactgaaggattctgcctggtagcctttattttctgtaaagtaggtgaagtcatctgttcagagagaagggaaaggtgctatagtaggggtcttgggacaactggtgaagactgacgattttctgagaagtgaggaaggagatgattttgtgtcgaatctcaacactgctgcttactctggacaagctttgtgaccctgaacaagttacataacttctctgtgcctcagtttccttatctgtaaaataagattatagtagtgcctccctcatagggttttttttttttttaaaggattaaatgggttcatgccttaaaaattcttagggcaccgcctggtacctagtgagtgctcaagacatgtttgttcttattattttggatccaactgttggtaaggatctagttgagattataggccacgaaattatattttccaaattcccatagttgtgttttttctccagaggttcttagcattttgagaataggactgcagagtgtagttgtagattaagaatctaggttttgccaaatggttgaaattaaagaagctgaggttggtgtaagaagtggttgaggtggtgagcaccttggatataggctggataagaagaaaattaaaagagaggggttggtgggaagaaaatagtgcggtccaaactcaaggggttttgtcaagattagtttacttctcggtttcatctgattgatagcttaaggtaaatgataattatcctgaaaagcatattaagaaatgttttggcaatgagaacacatggacacagggaggggaacaccccacaccagggcctgtcagggggttggggtcaaggggagagacagcattaggacaaatacctaatgcatgtggggcttaaaacctagatgacgggcagcaaaccaccatggcacacgtatacctatgtaacaaacctgcacattctgcacatgtatcccagaacttaaagtaaaaaggaaaaaaaaaaaagaaatgttttgggactgggtgtggtggctcatgcctgtaattctagtgctttgagggactagagtaggagtcttgaaaccaggagttcataaccagcctrggcaacatattgagactccatcatacagaagataaaaaattagcggggcatggtgggtgtcgcttgtagtcccagctgcttgggaggttgaggctggaggatcacttgagcccaggagtttgaagttacagtgagctgtgattgaccactactctccagtctgggtggtagagcaagaccccatctctaaaaaaagaaatgtttttgaaacttactttaccattggcttaggctggctcagtatttccttacacctcttaccattctaatgcatttattttattcatgtgtcattatttttaaggaaaacttagaagatgaatatgaaccacgaagaagagatcatatttctcattttattttgcggcttgcttattgccagtcgtaagtatatgtttatattctcacagtcaaatctggtgtcatgggttataaattggtgtgtggtaagttgatgtgttgtgctaaacataggaaaacccagaataacatcaggagccggttgatcatggggttgaacactgacagtaaattgtttggaagaaattgtttacttaaaaatattgaaaaaaattctatcgcagaattttgcctgatgaaacacttcttaagtttgtgagatagactcttcatttgggattttaaattggaaaggattttattgggaagaaggacttttgatatttttcctgcaaaaaaatggtaatatttataagaaacaattaatgaaacccacacttgaatttgatacaggtttttggaatttgagctctatgggccagttaaatcnaagatatttttgtttggtagttggtttcttttaagttaatagtgccacccagaggtagtaaagttagttgcttttwtaaaaattgtttttccctcacatgttaattttggtcacataatttagttatggctgtctttttttaaaattaatangcttatcaagtgagactctggaattgcttactatcccaagataataattgagaaattacttaccagttttggttctagagtttttcttctgtaaaaaagcatatgtagtttgtgaaatttatataataaatatgttgctgacaatctgtgaaaatctcctaaaaatgtgaaatcatattttgcatccagtagggtaattattttattatataacgataatgcccattagtatctgccttataaatgaacgttattgcttttaaatattgtggtatatatgtgcatattaaattttgtgaaattatcaattataaagccataagcaaagtttcctttgcaaagttaatctgatcaaagttgccttaaaaaatttggtgtcttttatttggcatttataaagacacctcaagccaaaggagtgccccatttccccattttcttttttttttctcttttctctctctctctttttttttttttgagctagggtctcatgccattacctaggctggagtacagtggtgtgatctcggctcactgcagcctcaacatccgtgggctcaggtgatcctcccacctcagcctcctgaggagctgggactataggcacatgctaccatgcctggctaatttttttgtagatatggggttttaccaacttgcccaggctggtctcaaacttctgggctcgagcaatctgcctgccttgacctcccaaggtgctgggattacgggcatgaaccacgacgcccagcccctattttctaacataaaatgaatattttgcagttacattaaatgcatgaagtattttatgttatttaaaaataatgcagctagtctcgaagcattcttgtatttaatctttttaatttttaacaccccctataccttgtacccaacccatccttagaagattgtgatatgtggtattgatattctccttaccgtgatagaggacttgcatgtttttaactgctgtccattggcatcttgctgatgtttgaatattgttttataaacatttcttagatttaataattactggatttttagtttgtactcataatttctgtcttcatttcagtgaagaacttagacgctggttcattcaacaagaaatggatctccttcgatttagatttagtattttacccaaggataaaattcaggatttcttaaaggatagccaattgcagtttgaggctgtaagtatatttttgtagttatttctaattgttctcaccattcatttttcccttctgtcttaagtgctggtactaatgtgtagtgtgttctctttacattctccaagtacctgcctgaaacagtagctaatagctttggataacaatatatctttccttctctatgactagaagaaaagggactccttaataacaaagtctcacacttacttgctctgttaaatgtgtgctttattaaagcacaagaaggtttagtttataaaggttcatctttaaccaaaattttgtcggccaaaataaagctaataatgtgttaaactagacaagtggtagtttcttatttatagtcgtgaaatttagaggaggtaatactttatttaaaagtcagttgtcaggcggggcgtggtgcctcacacctgtaatcccagcactttgggagtctgtggtgggcagatcacttgaggtcaaaagtgcgagaccatcttgaccaacatagtgaaacccccactctacaaaaaatacaaaaattagccargcatggtgctgcgcgtccataattccagctagtcaggaggctaaggcatgaaaattgcttgaacccgggaggtggaggttgcaatgagctgagatcatgccgctgcactctagtctgggcgaaagagcaagactccgtctcaaaaaaaaaaataaaaaccataaatcaaaaatgtcagtaagatctgtatgaatagttttaaaaaataattttgcagacatatctgaatgatttacatattgtaattatataaaaaaagaagagatctttgggactcatttaatggggatgagtattggaaatagaatttgtatcttttttttttttttttttgagatggagcctcactctgtcatccaggctggaatatgcagtggcctgatctcggctcactgcaacctccaccttctgggttcaagcgattctcctgcctcagcctcctgagtagctgtgactacaggtgtgtgccaccatgcctggctaatttttgtatttttagagacgtagttttgccatgttggccagggtggtcttgaaccccctgacctcaggtgatacacccgcctcggcctcccaaagtgctgggattacaggtgtgagccaccgtgccgggcctagaatttatgtcttttaggtagatatatgccacaatgggaatgtagaaacattatgttttggaagttttagagcagtcagatggtagtaggactggcagagactctattttgttgttggaatgcgtggcttaaagccaaataaaataaaaaagtagaagttgcaataggtgaaagacattgtcctgtctgacaagtagaagacatatccactgtagcaaggaacactatggagtatatgagttagggaaaagagactgtgaagggaagtgaacaaacattttgtagacgtttagtgtcaaatatatgctaggtaggcagtttctatagtttctttcatttacttcatgaggtttctaagtcacatctacctttgcatagacagatgtcatgcatggtaccatctgaaccaaacccartgcatcttccactttgcttttaactttgatccttggtgaagtccattattgcaattatcaattacagttaatttatccattcctattagaaatagtttattttttgcttttgttgaaattactgatttttagtaggtcatagagagaggtgtccttgagaaggtctattatttattctagggcagccatctccaacctttttggcaccagggactggtttcatggaagacaatttttccacggactgaggtcgggggatggggaggggtgtggatggttttgggatgaacagatccacctcagatcatcagtcattagattatcataaggagtgcacatcttagatctctcacatgtgcagttcataatagggttcgcactcctataagaatctaatgcctccactaatctgacaggaagtggagttcaggtggtaatgctcgctcactgctcacctcctgtgcagcctggttcctaatgggccatgtgctggtgctggtattgtggcctgagagttggagaccccagttgtagagtgtctcagcgtcacatatacttttttaaataatagatttattgagctagaattcacaaatcttgacatgcacccttttacaatgtataattcattggtttttagtgtaattacagattgtgcaatcaacactactatgtaattttagaacattttcacctaaaaatgaaacctcttacccatttatggtcattccctattcttcctctcccaacccttggcaaccactaacctgctttctgtctctggatttgtctattctgaacatttcatataaatggagtcatacaatatgtggtcccttgtggttgacttcttttacttagcataatattttcaagtttcatctgtgctgtagaatgtatcagtattaattttttaattgccaaataatattttacctgttcagcattcgagggacatttggatggtttccatattttggctattatgaataacgctacagtgaatatttgtgtccaggtttttgtgtgaatatgttttcctttctctcaggtgtatacctaggagtagaattgctaggtcatagggtgattctgtgtttaaacttttgaggagctatcaaaatgttttccaaagtggctgtatcattatatatcttaccagcagtggatgagggttccactttctccatatcctcaccaaaaattgttaccttttaaaaaaatatagccatcatagtgagtatgaagtggtatgtaattgtggttttgatttgcatttctaatgaagctgaatatcttttcatatgcttattggtcatttgtatatcatctgtgaagagatgtctgttcaaatcctttgcctgttttgtagttgaattgtttggctttttattgttgagtgttctttacatattctggatacaagtccattatcagatatatgatttacaaatattttcccccactctgaaggttgtcttttcttgatggtattgtttgcaacaaaaaggtttttttttttcagatgaagtctaatttatctttttttcttgtcacttgtgcttttggtattgagtctaagaagtctttgtctaatgtgaggtcataaagatttactcctacagttttttckgtaagagttttgtagttttagctcttacgtttatatctgtggttcattttgtgttaatttctatacayggtgtgaagtaagggtccaacttcattcttttgcatgtagatatctagttgtcccagcatcatttgttgaaataaccattctttcctcattgaattgtcttggcacacttgtcaagtcagttgactgttgatatggtttgattgtgtccccacccaaatctcatcttgaattgtagttcccataatccccacgtgtcatggaaaggacttggtgggaggtaactgaatcatgggggcaatctcccccatggtagtctcatgataataagttctcactagatctgatggttttataaggggcctccccctttgcttggttctcattccctcccctgccgccctgtgaagaggtgccatctgccatgattgtaagtttcctgaggcctccccagacacgcagagggctcaggattaaacctctttcctttataaattacccagtctcaggcagttctttacagcagcgtgagaacagactaatacaactgtaaatgtaaacatttatttcagtactcttaattttattccattgatctgtctgcttatccttatgtcagtagtatgtggtcttgattattggttactgtggctttattgttaagatttaaaattgagaagtatgagttctccagctttgttcttttttaagattgttttggctgctctgggttccttgcattttttaatgaattttgggatcaacttgttaatttctaccaagaagctagctaggatttacactgggattacattgaatctgtagatcagtttgggaggtattcttttgtaatgatattaagtcttccaatccatgaacatgggatgtctttctatttatttagatcttctttaatttttttcaacaatgtcttgtaattttttgttacatttatacctaaatattcttcaatgttattgtaagtggagttgttttcttcatttcatttttggaatgttcattgctagtatataaaaatccaggtgatttttgtatattgatcttgtatcctgcaaccttgctgaacttgttttttttttttktttttgtttttttgtttttttgtttttttttttttgagatggagtcttgcactgtagccgaggctggagtgcaagctccacctcctggattcatgccattctcctgcctcagcctcccgccggccaccacaccctgctaattttttgtattgaacttgttttttaattctaacagttttatagtggattcattatgagattatgtttactacagagatattctgactcctttctaatcaggatgctttttgtttctttatttttgcccaattgtccagctagaatctccagtacagtgttgaatagaagtggcaatagcagtgatcatgatctcaggggaaagcatttagtctttcactatgttgcatggttttagctgtgagttttttttatagatgccctttatcagattgaggagattttcttctaattctagttgaatattttcattaagaaaggatgttgtattttgtcagtgcttttcctgcaccaattgagatgatcatgtggtttctgtcctttattaatatggtgtgttgggccgggcgcggtggctcacacctgtaatcccagcactttgggaggccgaggtgggcggatcacaaggtcaggagtttgagaccggcctgaccaacatagtgaaaccccgtctctactaaaaaaaaaataccaaaaaattagccagacgtggtggtgcgtgcctgtagtcccagctactcaggaggctgaggcagtagaattgtttgaacccgggaggtggatgttgcagtgagccgagatcgtaccactgcactccagcttgggcaaaagagtgagactttgtctcagaaaaaaaaaaaaaaaagttctgttacattaattgatttttggatgttacaccaaccttgcaatcctggaataaatcccccttggtcatgttatataatcttttaatatgctgcttggtttggtttgctagtattttgttgaggatttttgcatctatattgataagggatactggtctgtaggttttttgtgatgtctatatctggttttggtattaggatcatattggcctcatagaatgagttgggaaatgtttcctcctcttccgttttttggaggaggttgtgaaggattggtttaaatgtttggtagaatttaccagtgaattaatctgggcctgggcttctctttgtgggtcattaaaattaccaattcattctctttgcttattatgaatctatttaagttttatattactttttgagtcagttttagtaatttgtgtcttttttggaatttattcactttatctaagttatctaattgattcatgcagttattcatagttttctcttatccttttgatttctttaagaaaataaaaggattggtgatgatgtcttctctttccttcctgattttaacaattagagtcttctctttttttttgtcatctaggtagaggtttgtcagtgttactggatttgttcaaagaaccaacttttggtttcattgatttttctgtgttattctctagactctatttcactagtttttactacagtctttagtatttccttccttctgcttgctttggtttggtttgctcttttcttctagtttcttaaggtaggagtttagggtatttatctgagatattttttctttttatatgtagacatttacagctataaattttcctgtaagcactacttcagatgcaaaccatgagtttttgtatgctgtgttttctttttcatttatttcaaagtattcttttttactttgacacattgattagaagtgtttaatttccacgtttttgaatttcctgaacttctgttactggttttaatttaattccattttagtttgagaatatattttatatgactgcaatcttttaaaatttattgaattttattttatgacctagcatatggtctgttctggaggatgttccatgtgtgcttgtgaagaatgtgtatctgctattcttggttggagtgttctgtagatacagtctgtaagatctggttggtctatagtgcttttcaaagcttcggtttccttgttcatcttctgcctatttgttctatccattattgaaagtggggtactaaagtcttcaactgttattgtttatttattatctttaattctgtcaatttttgcttcatttattttggggctctcttgttagttgcatatatgtttataattgttaaatcttcttgatgggttgacccttttatcattatgaaatgttcctctctagtaacatttttttgttgttgttttaagttatgtttgtttgacattagcatagccattccagatcttttatggttgttgtttacgtgatatgtctttttctattctttttattttcatcctttatgtgtgtttgaatctaaagtgtgtttgttgtaaatatcatatagttggatcatcttcttttcttttttattcattttggaagtctctgacttttgcatggattgttttatccatttatgtttaattactgataacttagtatttccgtgtgccatctatgtgtttcctatgtcttaaggtttttttgtttctgtatttctccattactgccttctttgtattaaaatggtattttctagtgtaccattttaattcctttgctgtttattttactgtattttttgagttattttcttcgtggtttcccttagaattacaattatattttattttaaaacaatctagttgggattagcattaagttaatttcaatagtgtacaaacttttgttcccatatgctctgttccctactccctgccattgtcctagtatggtcatacaaattatttcttaatatatcaacagaggtaaactttttgtgttctagattgtatgaaaaatgtatttataatactgtcaaacttgagtgtagtttgccttggtatacaggcaaatacctgtatgttgggaatattttttattggcattttggagatattgcttgctgaaccttttagcttctagagttgctcttgagaagcctgatttcattttgacttcttattctttgcatgtaactttgtgtcctttgccagtcccactctcttgtgtagtgaactttcatggcgatgtctgcaccttttttcacttttttgggttgggaacttggtggactcttttaatctgaagatttgattcttcagttagaaaatttctttttattattgctttaataatttcttctatgttctctttttataacctcttgttaggtggaatttatattttctggattggtactcttattttcttttcggtcctgacattcaatctttgtgtttttattttattttctgaaaactttcatcaactgttttctcaattttctatttatttatttttccctcctgtgtttaatttttttcttttaaatttacttaaaaattgaatataaaattgtatgtattcactgtaaaatataatgttttgaagggtacattgtggaatgattacatctagctaattaacaaatgtattacatcaacagttatttttgtggtgaaaatacttaatatccactcacttagcatttttcatcaatacagtttgttgtcattaactgtagacatcatgttgtacaatgggtctcttgaacttaatactcttaactgtgattatgcatcctttaacagacatctccctaacctcttttcctccctaaccaccccagctactggtaatcactattttaccctctatttctatgagatcaacttttttagattccacatatgagtgagatcatgacatatttgtctttctgtgcctggctttatttacttaacgtaatatccctgtttcattcatggtgttgyaagtggcaggattttcatttttttttatgactcaatattattccgttatgtatatatattgcatttaaaaaaatccatgtatctatcggtggacacttaggttgattccgtatcttggctattgtgaatagtgctgcagtaaatatgggtgtgcagatgtcttcagcatactgatttcatttccttcagatacatacccagtaatagattttgctggaacatatggtggttctatttttaattttttgaggaactttcatattgtttttcatttctacaaaaaataaaaaatagctgggtgtagtggtgcacacctgtaatccagctacttgggaggctgaggtgggatgattacttgagcccaggtgttggaggctacagtggactatgatctgtagcccaccctgggctacagaacaagaccctgtctctcaaagaaataagaggataataacgattttcacctcacagattagtgaggtttaaatgaggtagtgcgtatagagtgcttagtactgtgcatggaatatatgctgggtagtaatattacggaggatacagaagcagcatatgcctgtattgtgaagaagttcggagtcaattagattgatatgtttttactgcaattaaaaaaatggttttggaataggaacagctccggtctacagctcccagcgtgagcgacrcagaagatgggtgatttctgcatttccatctgaggtaccgggttcatctcactagggagtgccagacagtgggcgcaggtcagtgggtgcgcgcaccgtgcacgagccgaagcagggcgaggcattgcctcactcgggaagtgcaaggggtcagggagttccctttcctagtcaaagaaaggggtgacagatggcacctggaaaatcgggtcactcccacccgaatactgtgcttttccgacaggcttaaaaaacggcgcaccaggagattatatcccgcacctggctcggagggtcctacgcccacggagtctcgctgattgctagcacagcagtctgagatcaaactgcaaggcagcagcgaggctgggggaggggcgcccgccattgcccaggcttgcttaggtaaacaaagcagccaggaagctggaactgggtggagcccaccacagctcaaggaggcctgcctgcctctgtaggctccacctctgggggcagggcacagacaaacagaaagacagcagtaacctctgcagacttaaacgtccctgtctgacagctttgaagagagcagtggttctcccagcacccagctggagatctgagaatgggcagactgcctcctcaagtgggtccctgacccctgacccccgagcagcctaactgggaggcaccccccagcaggggcagactgacacctcacatggccaggtactccaacagacctgcagctgagggtcctgtctgttagaaggaaaactaacaaacagaaaggacaaacacaccaaaaacccatctgtacaccatcatcaaagaccaaaagtagataaaaccacaaagatggggaaaaaacagaacagaaaaactggaaactctgaaaagcagagcgcctctcctcctccaaaggaacgcagttcctcaccagcaacggaacaaagctggacggagaatgactttgacgagctgagagaagaaggcttcagatgatcaaattactccgagctacgggaggacattcaaaccaaaggcaaagaagtggaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaaagatatcagcaatggaagatgaaatgaatgaaatgaagcgagaagggaagtttagagaaaaaagaataaaaagaaatgagcaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacrttcagattcaggaaatacagagaacgccacaaagatactcctcgagaagwgcaactgcaagacacatagttgtcagattcaccaaagttgaaatgaaggaaacaatgttaagggcagccagagagaaaggttgggttaccctcaaagggaagcccatcagactaacagtggatctctcggcacaaactctccaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcancaccaggcctgccctaaaagagctcctgaaggaagtgctaaacatggaaaggaacaactggtaccagccactgcaaaatcatgccaaaacgtaaagaccattgaaattaggaagaaactgcatcaactaacgagcaaaataaccagctaacatcacaatgacaggataaaattcacacataacaatattaactttaaatgtaaatggactaaatgctccaattaaaagacacagactggcaaattggataaagagtcaagacccatcagtgtgctgtattcaggaaacccatctcacgtgcagagacacacatagcctcaaaataaaaggatggaggaagatctaccaagcaaatggaaaacaaaaaaaggcaggggttgcaatcctagtctctgataaaacagactttaaaccaacaaagatcaaaagagacaaagcacgccattacataatggtaaagggatcaattcaataagaagagctaactatcctaaatatatatgcacccaatacaggagcacccagattcataaagcaagtcctgagtgacctacaaagagacttagactcccacacattaataatgggagattttaacaccccactgtcaacattagacagatcaacaagacagaaagtcaacaatgatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacytgctcctgaatgactactgggtatataatgaaatgaaggcagaaataaagatgttctttgaaaccaacgagaacaaagacacaacataccagaatctctgggacgcattcaaagcagtgtgtagagggaaatatatagtgctaaatgcccacaagagaaagcaggaaagatccaaagttgacaccctaacatcacaattaggattagaaaagcaagaacagacaaatttaaaaggtagcagaaggcaagaaataactaacatcagagcagaactgaaggaaatagagacacaaaaatcccttcaaaaaattaatgaatccaggagctggttttttgaaaggatcaacaaaattgatagaccgctagcaagactaataaagaaaaaaagagagaggaatcaaatagacgcaataaaaaatgataaaggggatatcaccactgatcccacagaaatacaaactaccatcagagaatactacaaacacctctatgcaaataaactagaaaatctagaagaaatgggtaaattcctcgacacatacactctcccaagactaaaccaggaagaagttgaatctctgaatagaccaataacaggatctgaaattgtggtaataatcaatagcttaccaaccaaaaagagtccaggaccagatggattcacagctgaattctaccagaggtacaaggaggaactggtaccattccttctgaaactagtccaatgaatagaaaaagagggaatcctccctaactcattttatgaggccagcatcatcctgataccaaagccgggcagagacacaaccaaaaaagagaatttgagaccaatatccttgatgaacattgatgcaaaaatcctcaataaaatactggcaaaccgaatccagcagcacatcaaaaagcttatccaccatgatcaagtgggcttcatccctgggatgcaaggctcgttcaatatacgcaaatcaataaatgtaatccagcatataaacagaaagacaaaaaccacatgattatctcaatagatgcagaaaaggcctttgacaaaattcaacaacgcttcatgctaaaaactctcaataaattaggtattgatgggacgtatttcaaaataataagagctatctatgacaaacccacagccaatatcatactgaatgggcaaaaacgggaagcattccctttgaaaactggcacaagacagggatgccctctctcaccactcctattcaacatagtgttggaagttctggccagggcaattaggcaggagaaggaaataaagggtattcaattaggaaaagaggaagtcaaatcgtccctgtttgcagatgacatgattgtatatctagaaaacaacattgtctcagcccaaaatcttcttaagctgataagcaacttcagcaaagtctcaggatacaaaatcaatgtacaaaaatcacaagcattcttatacaccaacaacagacaaacagagagccaaatcacgagtgaactcccattcacaattgcttcaaagagaataaaatacctaggaatccaacttacaagggatgtgaaggacctcttcaaggagaactacaaaccactgctcaaggaaatgaaagaggatacaaagaaatggaagaacattccatgctcatgggtaggaagaatcaatatcgtgaaaacggccatactgcccaaggtaatttacagattcaatgccatccccatcaagctgccaatgactttcttcacagaattggaaaaaactactttaaagttcatatggaaccaaaaaagagcccgcatcgccaagtcaatcctaagccaaaagaacaaagctggaggcagcacactacctgacttcaaactatactacaaggctacagtaaccaaaacagcatggtactggtaccaaaacagagatatagatcaatggaacagaacagagccctcagaaataacgctgcatatctacaactatctgatctttgaaaaacctgagaaaaacaagcaatggggaaaggattccctatttaataaatggtgctgggaaaactggctagccatatgcagaaagctgaaactggatcccttccttacaccttatacaaaaatcaattcaagatagattaaagacttaaacgttagacctaaaaccataaaaaccctagaagaaaacctaggctttaccactcaggacataggcatgggcaaggactttatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttatgagraaaaaaaaacaaccccatcaaaaagtgggcaaaggacatgaacagacacttctcaaaagaagacatttatgcagccaaaaaacacatgaaaaaatgctcatgatcactggccatcagagaaatgcaaatcaaaaccacaatgagataccatctcacaccagttagaatggcagtcattaaaaaatcaggaaacaacaggtgctggagaggatgtggagaaataggaacacttttacacagttggtgggactgtaaactagttcaaccattgtggaagtcagtgtggcgattcctcagggatctagaactagaagtaccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagtaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagaacacatggacacagcaaggggaacatcacactctggggactgttgtggggtgggggtaggggtgagggatagcattaggagatatacctaatgctaaatgacgagttagtgggtgcagcacaccagcatggcacatgtatacatatgtaacaaacctgcacattgtgcacatgtaccctaaaacttaaagtataataataatttaaaaaaatggtgttgagtctttttgttttaggaaacaggaatttatgggaaatgtatgcagttttaacaagagtgttggtgtttaaaattactctagttgcttctagtctgtttgccatattttatttatttataaatttatatcctgtttcactttgctaatcatttgaggtgcattataatgaacctgtgcattaaagtaagatgcataaatttggataaacttgaaagattggctgaagtgatgattaatatccgtatgtatacatcccagtgtggtgttatacagcttctaaagggagcagtaactttgccttcttgtgtgactattttgatttttctagttcagtgattctcagtggggggataggatggagaggtagtcctcctagggtgtttattagaacgtcggtggaggttagtatagagtatagaaaacattatgccttatgtttttgaaatataaaccatagaatgtaaagcttgatcaagtatttgtggctgatggggattcatggaagatagagtaacaaagtattgcagagggcttgacagaataaccattcccgtgatagtctgcaatcactttccaggcagagaccttttcccatctttttcatggactctcccatggcatctgatactggtaattaaggcacttgaattcaggtgctgttgattagcttgtccccaggtctctgtaagctctttccatttcattgtaggctttcccaatttttatcatttcattaataggaacatgcacactttcatcactttggttagaatatttagtttgcatttgaaaactgctatagctagtcaggtatcagtgatgcttttagactcatgacaaagcaaggtttggggaaaagttactagcatttgtttcatgaggtggtgtctgatgtgtgacctgctgcctaagtcaggtgctgctgcataagttgaggtggaaggaaacagcagggagtgggcagccacggggccatcttgtttgtcacagaagctggattgttggcacacatgtctttgagtcaacctggacttaaagtgcttgtgtgctgtgtttgtgtgcatttctctgtcttttcggtttcctcaatgctgcagttgcttttatgttgatctacttctgtaaaataaatatatttttaccttaggaggagatgcagtgttatacctgagttgtattgtgtccttcgatggagaaatatgtacataaaaagggatcattaatttctggtgttctattactgacttgggcagtgcattgatacttttttagtctatactgggtttctggtggatagtagattctgaatccttatcatgtagtataggaagccttaatatgaagtgttcaaaaaggaaactgatatttttcattctttgacctatatgtaaataaattggattttaaatctgaaatttctaaggcgtttcaatgagtaaatattgctgtccatggtgactattttgcatctcccactgctgagttgattgacttaaccttggtcacattaaaggtgaatgggtaaggttaaacagattctattaatgtttcttcagttggccagttagggaaaggtcagctttggcagctgtcagccttacagacaaagggtttctgtgctctcgcagtctagagtctgacagcagcttctaatttacttggatgctttttaaaacctccttaagacagtcaagaaatatttcttattggctttgcaataccagtgggtctaatggtaggatgcttttcattagagtactacagaatggcagggacagtgaaaatgagcattcttaaagatgtggaagaatattctgtgtgtcacaaatgatgactctacctcatattaaaaagacctagtgttcagttgctatttatgttcagggaagtgagggcttttgggtgaaggcaagtgaagttggtaacctcgttgcctcactaaaaacaagtacacgtaaaactttgaattacttctgtttatttaaaagtagtttttcttatcctgagcctgacatctaaaatttgtttctcatcccttttagtttaaagccttaatttcttttatcttagaaattatttcatgtcattcttggttggtaattacttttcagtgaggatgaattcaagtttaatttgtcatttgttattgaaaatgtcaattatgaatttattaggagcctttggaggcttttctccagttaacattggaacattgagtttacgttgatttaatagttttaggtgtattgaattttaaaatacttttggtattctgtcttgatttctgagatactgcaagttggccttaaatagtcatagttttttgatcattttggcccttactgtgttgtttttattgtttattggtatagtttgggttgtcatagttcgtttcgaatgtgtattcattatcatgacctactccatttctattatgtaaaatatgaacatcccatgcattgatatacatgactytctttatacctaccctcttgggtctcaagttattataagcctattaacaagttgcaaagcaatttttgtgtgatgcctgcaaaatagagagctgtgtgtacctttttatatcttttgacacagaatgaactttgatacagccaataaggagtctggtggaacagctgagacaggacacacagatgtaacagtagaacaggctagagaacacatgtgtttgataagcctggaagcttttcacagggcttctggcaagccgttgactatgacaggagtgaaaatggagcctgaagaagagtgaagtgggatggtaaaacacacactctcaaacactcttagtggaaattacgtaaaaggaattaggaggaacgggattaataatcagatgaagagtgttaaagaaaaaaaattattcatgtcatttgttaaggatagtaaggaagactttattcaaaggggctactataataggtttttgtagtaggggagagagagaagctgaagttggaatatgataggataggtggggatttggagcaggggtcagggtggatggaaaattattaagaggtagtaaagtgacctagggaattttgctgaaggcagaccaggatcataagatattaaagatggtcagacgaagggtgggggattttccctaaacttacttagcaggattctcactgaaactgaattagcaggccttatcaagaagaggtttcaggagcttgacaagagttaggtcaaggagagagtctttgtcaagtgtcaaacataacttctgaatagagaaataaattgttttatgttccaaggctgtgaagtaggcaagattgacagtcccaggcagggtactctctgagtgttgagtgaatgtttaatgtctagagaaaatactaactgaattcaaaagatttatctcaattctgtttcataaacactagacatctttaagatgagtatagcaaaattgagtaattattttttttcaaggttaaatattagataataggtatatgttatatatgaaatgagcttttctattgagctagatttgagggattatgctgccttgcaaacttttatttgttctgtttctagggaagtttatgatttagaaagagcactgtgtatttctgttacaattgaatacctttcaaaatgatttaaatgaaggcattaacacagggcttcctttttaaaagtaaacactacaagtataatacttttgttctcatagtggtttttggcatcaaattattatggaagccaacctggtattattttatgtatatttattgggcagttacagtaaaatattgatacattttatatttggagaatggagaaaagtttattaagttttctagttagttgaggcctaaccatttatgcatatagttgtaaaaatacaccatggcagatggtcttagtgacaatattttagagttcacagaatttgggtttttctaatcaacctacaaaattagattctgctcatgataatatggtttaagcctagagatgctatggctaaatgtgaaacttcaagctgaattacccttaaaggctaaaattatcatatgcagaaatttccaaaatgacttgtgaaagtcatttctcttttttaaagttttcatatagcttttgaatataggactctttgtattcttattgttgatggctttccatgcctataacttttgcccttgaaaaaaaagtatgtctttaaatgagctgaagtttcccccacacagagctatgtcctatttgttttataatgatatatatctatttcaattttattaatttttttttttgagacagggtttcactccattgcctagcttgagtgcagtgacgtgatcttggctcactgcaacctttgcctcctgagttcaagggtttctcttgcctcagcctccctaatagctggaattgcaggcatgcgccaccaggcccagctgatttgtgtattttttgtgtttttagtagagacggggttttgtcatgttggccaggctggtctcaaactcctggcttcaagtgattcatccacctcagcctcccaaagttctgggtctacaggcgtgagccaccatgcctgatatatatatatgtgtgtgtgtgtgtgtgtgtgtgtgtgtgtryrtacatacatatatatttatatcctcaaagaatgaaattaattacactaaatataattttcagtgttaaatattctctgtagtttaccatttacattatggaatgtagtttccagaaaggggttctgatccagacaccaagagagggttcttggatcttgtgcaagaaagaatttgggatgagtccgtagagtaaagtgaaagcaagtttattaagaaagtaaagaaacaaaagaatggctactgcataggcagagtagccctacgggctgctggttggctatttttaaggttatttcttgatcatatgctaaacaagaggtggattattcttgagttttctagggaagagatggacaattcccggaactctgggtttctcccctttttagactatatagggtaatttttggatgttgccatggcatttgtaaactgtactggtgctggtgggagtatcttttarcatgctaatggattataattagcatatagtgagcagtaaggatgaccagaggtcacttttgtggccatcttggttttggtgggttttggctggcttctttaatgcatcctgttttatcagcagggtctttaggaccttttgtcttgtcatagccagtcttgctgaccctttgtctcatcctgtgcctgagaatgcctaacctcttgggaatgcagcccatcaagtgcgagcctcatttgatccagcctttgttcaagatggagttgctctcgctctactagagtcttttggcagtgttactcatggtttctgaaggtgttctgaaaaaagatactgagcttttaaatgtatactttttttttttgagacggagtctcactctgtcgcccaggctggagtccaatggcatgatctcagctcactgcaacctcctccgcctcctgggttcaaatgattctcctgccccagcstcccgagtagctgggattacagtcgcccaccaccatgcctggctaatttttgtatttttggtagagacggggtttcactatattggtcaggctggtcttgaactcctgaccttgtgacccgcctacctcggcctcccaaagtgttgggattacaggcgtgagtcaccacgcccagccatgtatacatttttaaaaattccataatctttataatctttccctctttcctccaagttccctgaaaagttaattctttttggctgaagtcttgtgtcatggtctagttcagagtctaggtcagattgccttatcctaggtcttttggatgagaataagaaccagggatgtggagggcaaatggagttgtaaaggtaatcattttgtgttctcagtctttgagtggcttaatctgagttacaaagggaggaggaagtagttgcgtaacaaatccatttggtccaggccctgtgaatatatccattctgctactccccacccctctgaaggcatacaaaggacaacagcacagttaatacccctattctggacttgtctccatttattctctgcttgcttctgtttgtttatctccatgactttcaaataccttgtgctgtacttcggctattgatacctgcctcctgtctggctttgtttcctgttcatctctggtcaaagtgtgctctccccattccaggagaatccttctgttatcttggagcttaatagccaaatatattccaattccctttagttggtccaaggaataaggcttctgtatgaatattggaaaacccagaggactgtttccagacttggatggggtccttgttttctaaaggaggaatatttattgatgactgtataagtagtggacttattaaggtttagatttatctggtgatataaggagactgaggagagattatcactaatagctaacatttgtaatgtgtttgttaagtgccaggcactttggtaaatacttcacatgggtaaaaaaatttaacttcttcttctgtggtagagacagttttgctctgtcgcctaggctggagtgcagtggtgtgatcacagctcactgcagccttgaactcttgggctgaagtgatcctcccacctcagcctcccaagtagctgggaatacaggcgcatgccaccctgcctggctaattttttcttttatagaaataagttcttactgtgttgcctaggctggtcttgaacttcaggccttaagtgatccttgcaacttggcctcccatagtgctggaattacaggtgtgagtcactgtgaccagccaggtttatgtaatttaatcctcacaacagctccatgaggaaactgaagctcagacaggttaagtaactttccttaaaattagtcttctaaatatttagagatgtataagtcacaaagcatgttactaaatatatgagtagatttcttcacagcttaactattgaaatgaagtggaatagatgctgacatttaaggtgacagggcccatcaaaagtgctatacaaacacaggtgtgagtttagagatttacattagtttcggaaattaaagcattaactataattttactgagatgtttcattttagctgacagttgttggcaggaatggaaaccaaatatattaaatataccattggtagctttctcggtataatattgccatctctagggaaaacattatattcacccaacttagtcgttgaggggtttgttttctagcccgtagtttttctatgccctttttgtttttcttctctgctaccttttgtttatctttttaaaaacatttttcagatcacattgtatattttagttcatgttcaacaattaactcatgtataatattcaaagatcagtgtaaatcaaaatccaggcagtaggtaaaaaatatatttttaaaattttaaattaagttttatcaggcagtagattttgtacttgaagtgggagtcattattttaataggccaggaaaagaaaagttatggacttgagttggttttttttactatctcacaagagagatgccatagaggaaagcctactgtttcaaactgagcctttcacaaggatggcttgttggttcagtccagtagttctggactataggggttatagtcacccctgctggatattttggccatctttatggtatttttggtgtttgtaaaaatgattggcaagtccaacaggtgtttagtagacaggagatggggatgctggtgcatttacagtgcactgagtagttctgtacaaccacagattttcccacatccttcctgcccttttttttttttttttttttgagacagagtctctctgttgccaagctgaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagatttgcaaatgataatgtatagggagaacactggatttcatcccccaatacccacttgagttctttaactgtgctacaaatatatgtagagtaataagttataagaacttcagtagtataaagctaatagaacttgaaatactagagtcttattaaaatgaataagcacagatttgagtccaaatcttcttttcatgcagtctgaggaggttagggatatgtgtaaattgttgctaaactgacagctattggaagaacctgatcatgagcactttttacatttgaattcaaagggtaaaaggggaggttcctttaaatttagttattttttggcttttagaggattagatttgtgataggataaggaataatagagtgctgttgattttatcctggctaagattaatagtctgtttgccacttctatgcctaaatgtctctagaatctgtccatctcctttcagtttcattgtcattattctagcttgggctaccatgatttcttatccaatccattcttttttttttttttttttttgacacggagtcttgctctgttgcccaggctggagtgtagtggtgcaatctcagctcactgcaacctcggcctcctgggttcaagtgattctcctgcctcagccwcccaagtagctgggactacaggcgcacaccaccatgcccagctcatttttgtagctttagtagagacagggtttcaccatgatggccaagctggtcttgaactcctgactttgtgatccccccacattggcctcccaaagtgctgggattacaggagtgagccaccgtgccggcctatccaatccattctttaccctgaagcaagagtgcagatatttacagatgtctatgctacagcccctccccaactcttcagcaatttcctattaatataatgttaatcttcaaaatttgtaataagttacctcaagctctcatccctgtttacctccctagcctcatctcttaccactaatctgtaaactctatggaccagccatgtgaacttcctttagttgtgaaaacatgttttttccccttgactttggatactcttccctacatttcgtctaattctgactcatctgtcatgtatcagcttaaacagttttctttctgggacatttccttaagtttagcgtagaaacccatcctctgtggcttttttttttttttttgagacagtttcgctcttgttgcccaggctggagtgcagtggtgcgatctcggctcactgaaacctctgccttctgtatgttcaagagattctcctccctcagcctcctgagtagctaggattacaggtgcctgccaccactcctggctaatgtttgtatttttagtagagatggggtttcaccatgttggtgaagctggtatcggattcctgacctcgtgatccacccgccttggcctcccaaagtgctggggttacaggcatgagccaccgcacccggcttcctctgtcagagcacttgtacttgagggttatcacccgcctgtcttgaaatgggctctaagtctcctgaaagcaaaggaccctgaatatggtgtttattacctaacacaatgtctagcctataggaggtacttaatytatgttggttgaacaaaggagtaaataaatgaagtagctacctacagttgttccccagaagatacattacttaagcaccctagaaactgtttggccttttgaatgtttattgtaaagtttaaattctcagttgtttgttcttagtttgtgctaacagcttcataaaatgggtagatcaagcaatagtgtgcagttagcaaactgggtccacaaactcaagattcaaatcacttttggctaattgtgtacttatggacatcagattgctcttgtattaaaatttattaggcagactttgagtgggaaaataaaaatcttgatttggtagatgctggagaacagtaaaaaatagaaaaatttgcaggttggtgagatttcccagattcagtgtgtggtgtatctctaaagttcaaaatccttcaagaaggttgctggtgtatgctgggtgtcagaacaggagagatgtttttaacacctagcacagctgcaaactaggtggtctggaatttgcaagtacatctttcagttttatttcatcttgaagctttcargtgggtttaacagttattcaatgtaattgaagttaatgtagctaaaattgcatattatttttgaagtgttaagaatgaaaataatttatggtctttaagaatgaytatgccaatatttcatattctgtattggcagtacagtaaaaattaattattttcactataagtattatataaataataaagatatttaggagggagtatatatgctwataggaaataaatgttttgcctcccaggagatcatcttagctggtacagtggattaaaaatggcctcaaattatttgarattttctcattgagaagtgggatctatgtcaccaccccttgaatctcagtagctttaaaaaattatggttaaatatacataatctttacattttaaactatttttaagtgtacagttctttgtcattaagtgtattcacattgttgtgcaaccatccccattcatctccagaactttttcatcttctccagctgaaactcattaccctttaaatactaactcctcattcttcccctgcccacctcttgatgtgagtgggttttggcaaatagagtatggatggcagcagtgacagagtaccagtgtctgggtacaggctttaagaaactgggggcttccactttctgtctctggtacacagtcttcaggagctctgggatgccattaagaattctaagtagacttgatggagaatctgttctgaaacctggcagtaactagtaattgccatgctggagaggcatgttgacattcccacctgagcccagccttttaagcatccctgtcaaggtgccatacatgagagcagagccatctaagaacctccagattaatctgttcaccagctcagtacctctggtgacttcatttggtgccacatggagtagagacattgycagcagcaccctttctgaatacctgaccatcagaattgagagctgtaatacaatggctgttattttaaactgttaagttttgggatagtttgttatycagtgatagataattagaactggtagctagagcttctggcttcttgagtttgagctgaaaatagcaatcagtgtatcctaaatacctcaaaacaactgtactatgatttggaaagactatataaaatgtaatgaaagatnctattaacaattaaataatatggaaaatgaaattccaataattagttgagtggagaagacaactctgaggagcccagattacttagaagggacagaaatgggaaaattgttgataaatgcttttcacctttcagaaatttgattggtgaatctgcttaaaagttagctgagaagtttgtggctttttcattttgaagaagagatttgccaggagtctgagaatcctttaaattrttccaaagacagctttattatgtttaggacagtggaaagtaatgtaataaggtataaggtatgagataatgaggttgatgtttttatgtggtgcncttagccccttagagtttgccaaaatttaaagcagaccaagtttaatgagtgtacttcatagtatagattgtggacagtcctttttgcttgctaaattcartttagctcagatggtgaataccaatatgttcagagtactgtgtaggtgctatgggggatttaaaaacaccttcttaagtagaaagaggtataaataaatgaatgaaacaatcataagttactatagacaccacattatacaggcttcttaatttttgtatgccatttctaaatggttgcagatttttctccttttattttcagcatttaatgctttatattggctcttgatatatggagtttggattatggaaggtaagggggagattttaattcatatggaaatctatggaaattatttcttactgaaaaactgaaaatagataaaataaaaaaatacaatttcgtaagtccaggaaagcaggacagttgaggcctaataatacccttttgtgttggcagacagatttgctgctattatgacactttgcttaaggaatgggagtatcgtggatgaatacaaacctatacacagctgtttgtgtttgctgcacagctttctggataccttaagctgtatcacttttggattgtaatgattttactggaggcaagaaacaaagtgaacaagatacagcatcaaaattctcttttaagtttcccaaggctgctcttatttctctctacaaaatagaaataataattttgccytttttttgataacactagcagtagcaagcaaagtatagataagaacaagtgacatattttgagtaagtgatcaatgtcaggatctttacagagaacaatargatggatctaaaatgaatgaactgagtgttttctctttttttgcagttttggggggcatcraatgaaaatggccacatttaggtagggtaggagaacaggctttggaaggagcgggtattttattacagtgtgaataaaataaatatttagaacattayaagaatgatggctgacactgagagattcatgttaatgttataggtttctcaaggctgataggagctcttatattgtatttctaatgtagaggaatagaaggaaagctatggatggggtgcagaagaatggccctttggcagtgtkggtagtgctgcttcctgtcacactctagtgttacagcacttataaactggatgtgccttctgaggatactatcctttctgagtgcatcgtggcctcttcctatatttgaatccatgttttaagtgcagatgaagcgcttggacactgtggcactgtaagtaggattagaaccgtgacttaggatagggtataaccaaggggaggaagcttggtggaccttgaagtaagataaatgtgtgagtagcctctttctccttcttgatgcagggcacatggatgagatggttgggaaacactttttaagtccctgtsaatgtcaagaagtggcttgaaggggctttaatctctcaatcccttccccaccaaggtaccccagattaatgaacaattgataaaaagtgtgctttctatgcaaatgtgtcttttaagataagttccctagcaaaatcccactcctaagcacatcctatgtagaaattctggagccactgttgtcctttatattattttatagctaatatttaataaatgctttatgtgtgtccagcattntgttgtatgttatggaagatttgcattaacatgtttatagttgaagagagcaggaaaagwctgatttcaggaaacagaacaaggtaaaataatctggtgtcagaatatttnatatggtctacaagggttatngggggaaaaaaaagtgggcattgccatgggctggattaatgtaggaaggcgtcattgagctgacagctgtgaacagcatcttaaaagataaggcagaaaggaggtagcagagatactccaatggatggaatatcatgtgccaactgcaactttaaatgtctgaataattttctgaggaactaaaaatattgaattgggtcaacaaataggatacctttgtcaaagccatagagctgacttctaatattttcagttacaaatatatatatttgagcatcttttagaataaacacctcccttcccttcacaccaggtaaaaaaatagctggtattctaccatccatatgaatttgaaatatacgatagaaatataaatttagtaacacctgacttattaaaaattgccaaagatttgatttcctatggtctataagagaaaattgctacaaatcaatttattttttggaatttatttttccttactcttattgcttgaataaacgtggctgcatcagtggttcatgttgactcaaagcaagtttctccctttcctctccagctaaggaaagccatatttttttttgtactatgctactgttagctgcttggcttggaagacttcggttatcattatatctttcatgactcagaatctggctgcctctctttcaatgatcttgaaaatgtccaagatgctgcatgatttagaaatgtagaaccaagttaagttgaacagttttctactgggctacattgtaaaaatgggaaagggaaattacttcctttttttttttggaaaacacttgccagttggagcctcaaagaagattgagtttgagaggcctttaattgtgcaccaaaaggttattgcagaagataacataayggagatgtcataaagaagaaaatttgaagctcagtaagagaaagctgtgtgaaaaaataggcattctgccaattaactgggtgcttgaaataaatagtttgtaattaaagaaacggttgcaaatttcaaagacttgatcagtttaacttagctcatagggaaaccggggtggtggtgggtacaaatttcagttgtgaaagcatgcttactctcattaaagttttgcttatcattcattaaatatttactgtttgtaaggtttagtaatataagatcagaaagtttgttaatctaatatttaatgttaaattattgaaataaaatttcaactacatttgggtaaaagtgaattatgatcttaggagttcagtcatgaactattgaccatctcagtagttaytatttcccaaactgggcaaagtatgggtgagagtgtgtagaggggagacccaagaaaacatagaaatggtccatcacccttgggtctactcatctactgaagaaccatgacacaattatatatgtaagcaattagtaataaaatatcatatgtttataagtataaaggagacatacaagaaaacattaaatgttcatctttccatacatgtctgtcttcatgttgcattagtttcaagtgaaatgtgtttttttatgttttattactatatactataccttttcatccaaagaagaaataagagattgtctcctttattggaagacatttttgctggatgtagaattctaggttggcatgtactttcttttagcacattaagatatatcactctgctgccttctggcttctcctcttgctgtggggaaatcagctgttagtctaactgtagctcatttgaaggtaagacagccaccctgctcttagtctccttttaagatattctatttaatttacttttgtttgatttaaatattctgtttgtctaggagtagaattctttttatttatcctgcttgagtttcaccagcgttcttgaatttgtagattggtgtcttatattaattctggaaaattctcagccattattgcttttaaacttccctctacctgttctttctcctctctgtctggtgtgttagtcaactgtattttaggtcttcttagtcattcacttttcatcctcaggttgtgtcttccttctttttgttctttctctgctgagttacagattattttttctgaactatttcccagtttgttatttctatattctgttttgtctgttctactcccattgaattttaaattttggctactgtaatttatttgttttttttttttcacatctgctatgttgctttttatggattcctattccttgcagatattttaatatttgcttttctttttcaaatttgttgtaggttgctttttaatctgtctgataattctaagagttaaaatctgtgtggtctgttcctgctatggtttgtgattgtctttcacccatgttgccttatttccttgcgtggttggttatctttaactggttattgccctcccacagccttttttcaggacattttcagggtgaatgtgctctcctctgagaggtactgtgtttgcttttgccaggtttctgagagtattactttaggggtattatgtcaggtattaagtcaaggacactttttaaaccgtatttaggattgtgtctctggcccatccacaccatatatactttgggtggccacagcttctcaaaaacttcattttcctacctttttcttttcctgctttgctcagtgacaagtcagcttgcccttcgttcttctgtggttaggagagagatggtgggtcaattctagttcactctttctctgaagatgttcttcgtttgggtctccagtttaatatagggagggcctcttgcaagagtcttccgcttggcaggccctaatccttgtgttttgctaccttgccccttgagactgaagatctgaagtatgaggagatggcatttactaatgtcctcagagcaaaaatggcattagttctcctgggtttgcctcaaaatttggccaacaagttcccttttaaactaaatattagtttaacagtatttttaaaatgctgttaagctaatatttttaagtgttttgtccatcatttttgttgttttcagtgagatgtagatctgaataacttaagaaatcagaaactgctaatagcacggagcccatctgctgctgtgctgttggtgatgttgcaaatrgttcccctctccccttaacatattctgagcctcaagtcaagacagcttactgggctggagaggtgatggtctaaagaattataaagattttttaaaaatttaagttaaaatagcttcttaaattattatatcaaattaatagagaagtattatttctttaatttgtttaactycccttgtgctcatctggagaaactgtcaggaaagatgatttttattaaaggcactgctgttacattcactcaggcatgattctgtcataacttcttggtatttcctttctatctttcttaattgcatgttttccctccatctctgtcacagtgccaattctaggactgccttattactgcttgttggtctagcaacttcttaactgttctttaattattagcggaattgaacattattttgtgtgtatgaatttttgtgccttttcgtgaattaatctgttttttatcttttgatgaatttattttattacatcctatcattaataatttttagtcttttggggtttcatcacacagaatatttatttttctcttattctaagcttttctgtatttcttcagtttgaatattgtcactttccatagtttgtatatttcagtcagtaaacattgcatcaggtattgtggtaagaactgggaatataggctgtgtgcggtagctcgcgcctgtgatcccagcactttgggaggccaaggcaggaggattgtttgagctaaggggtttgagaccagcctgggtaacataatgagacccggtctctacagaaaattaaaaatcagctgggcatggtggcgcgttagcacgcctgtaatcccaggctatttgggaggctgaggcaggagaattgcttgagcttgggagatcaaggctgtagtgagctgttccagcctgagcwgcagagtgagaccatatctcaaaaaaaaaaaaaaaaaaaaaaaaagaactgggaatataatcgttatgacacatttacctgtgcttaggttcatatgttagtgagggagatataaatgcttatagtattgtacataaataatataaaaaaaaactgtatcttcaagcagacaggtatgtaccagcatggaggtgggagtaactatgcctaaggaaatctggtgcaactttgcagaggtaacctgttagttgcatagaaatttgccagtagaaacacagggtatagaaagacatttcagatgtgggaaatatgtgtaaagtcatagaagtgaaagaaagacatggtgcgctataggaagtgcagataggttggtataattggagggcaaagtattttaggggaagaaaattgaaactagaaagagtttaaaggcctgggataaaaaggaactttgatggacacaaagagcctgtgtagtggggataatggagtaagtgagcaggaaggacatggagatgtggttggggaaaatgtgtgagggtaggggtgatgcgttgcttgtgaattgtgctgtgatcgtgggagtgggctgcagaagtggagggtgagtgggtcagaggatgcygacgactgtgaaactagtgttgactggatcatccatatgggtgtagcagtccatttggacagtggcaagaargtggatgttntgatgtcgacaagatttggatttgkaccgtgcctgttccagttttagtactgraagtcccacatccttagaaacctctcattcctggacaaactgggatggttggtcacnataatgaggtgccagaaggatatgatgaacttgaggcattgaaacgtggagagcaataatctgtaagtggggagcagctggctagggtggaggaaaaaggagggaataaagttatgttaatttatgctagcacggtgttctcatgagatagcaaggaggtagaggtcttgattaaattacctattttttttcaaaaatatttgttttcttgtagaagagaagaaatatgctttagtataagtaaataatctttcctttttagtgttaattttactatattccaaatgtgcctatgctattaaaaaagaaacagtaatgaagtaaccagacaattgatttttatattgattagcttgacagtattactgagacatcaacatactaattagaatgtcaggatattaaattattcattttctaacttttaatgttttggatgattataaatgacaaaaaaatttgtgagtgaagtaccatactatcctatcaattttagttaattaattcagccacagagtggtaattatttccttttttattttctatttttgtctctttgttaaagattttccaattaaaattttttcctattatatggctctcctttatacatttaaatgaagaaagtactttgtaagaactggattacagatagaaaaaaatgtttaaaactaacttattttaggttgataaatatttgggttatttatcactgtgtcagaaatacctccaaacctaaaacaacaattccaaaacctaacattaaaacttaaaatcaaaacttaattctaaaacttaaaacagtacccatcttattatatctcacactttcgagggttagggattcagaatgggcttacagggcaattgttctgttccacatagtattatatatgggctttcttagttgacaactagtctggtctaggatgtctaagacagctttactcacatgcttgtgcatatgtgaggacttctaaaaggctggactctgctggacgcctttccatgtgatccctcaaacgaggtggttggacttcttacttcatgatctaggactccaagtgaacaaggcagaatctgccagtcctctcaaaaaataggcctgggcctggcagggcatcactcgttcctgtcaaagtagtcacaggccaggccagattcaaggggagggcaaatagatcttagctctcaacggaggatgtgtcaaagactttgcagccatctttaatccccatgtactccagattgatgattacatcacagtgcatttgggaaacaaattgccctttataatcacagtatttgctaccaatatagaacctatatttatttgaaatgataataacagtattaaaaattatgatatttgctttcagcatttgatctattcacagttttaatttctttataaatgaaatgattcctaattgttttatatatatcatatatatatcatacatttattttagaaaagcggattcttttcctgggatatgctgtttagaccagtgatgtatgtcgaaccactaatggaccttaaaaaaaaacatacagctcagggcttcagtctgtaggtctgggtggcaccaggaatctgtaattttaaaaagcttcactggcaagtaatgtacatacttacttaatgaccagggtctaagaaagctctgtagattcaaatagaaactatccaaactatttataaatgtgattgagtattgttgattggaagcttatagaagcttaaatctctgggaagccttatttatatctttacttttgatgccagtgtactagactagtggttccaacatggcatccccaagatgatcatttgggaatgtgggaaagaaataaataatacaacatatatttttagtctcatccgttccacattttggggatgggtatggcatgttttaagtgcagaatgtacagtaatacatacatataatttataaataaatatacatatattggaagtatgtgctgaaaaaacttcattgatgacaatgtgtgatgcaaagatgaaggtcactgttccagtcagtttagtttatgcattggtaacgacccccaaacctcagtgacttatagaaaggtttgttccttgttcatattctgtgtcttcatgggccagctacaaccctgctgtgtgtcattttgtccctggactcaggcagatcgagtaggctctgtataccggaacttcaccagttgctgcggcaaaaggaggagagaactgggtaaaatacatgctcagaaagcttttgcttaggaataacacacgtcacttccactcacatttcactggccaaagcaagtcacttggctacactttagttcagcaggtagggggtgtataattctccctcagtgagggactcagtacagggtgaatagcgatacagtctacacagacatccactacccttctatttactgtgtagagtatttgcctctctagagctgctccttaatctgctttcaggatttcaacagagtgaaattgcctctctcagttcctggtttgatgaagaatataaaaaagaaaaagacacacagccaaaatccttaattctgttagcaaggcagcatataaaacaacataattttggaatatggaaatataactttgccaaaacagttaaaacccagtgtaatttttacttgataaaaaactataccgttataccatgtgctaccatttgaaacantcaggtactgactgttgagtgggtggatatgaataatagggattgagatgtggggaattatgagtagtagtggcaagagcagaacttcaaagctagaatgttcagagtctctgttgattggacattaatcagagtgaaggttgagcatctctaaaatagtaatgtaagtcactcaaaaaatgtgtgtttcatgttgagccatttgtttatacacctctttttaggaggatgtttactttgtgaagcatactacaccttgattataagatgttgcagtgataacctagctggcttttatcagttattttgaattcccctatacaccaagacctgtgrtagtttaatgaaatgacaagtttatagaaactgcattagttgcagtaaacatttcactttattacttgaggaaaaagcctgaaataragaaactaatcaaaatgtaaattacaggtagtaacaacaagtgtttaccatgtactaagggtgtgctgtatgttaggcctattgtacacacttracytactttatttaatcccaagaaaagctacatgagataggtatgattttcttcattttatccctgaagaaactaaggtgtaaagaggttaactaacctgtttaagattcaaagacaggtttctatgattttgaaaactattctctctactactttactctgcttttataattgttccactctatctgtttttacttgtattctttgttagtagaagtaggaagccatttaatcttgtcttgctctttcagagaatgagtattttttttaggtatgcagcaggtaatctcatttaggagaacctaaataaatgaaatatccttatattttgtccaatagtttttaaggagaaagcaagagtaaagagaatattcaggattattttaggatttcaaaataatgaagttaatagcagtttatactaattatttaatagtaaagtttctgacagtcatcctacatttttcaatgagaattgtcttgtattttccatttccattttggttataactaaatagataaatgaagatttagaatttgtttgacaaatggatgtattttttaattcatcaaagaaaaccagaatatttactcataggccatgaaacaggaagtgacatgaaatttagatcgaagtgcatgatttagagtgtgtttgcttactttgggtgaaaagtttagaaacacattgaattccttagaattctatctatarctttttttttttttttttttgagatggagtctcaccctgccaccygcgctggagtgcagtggtgcgatctcagctcactgcaacctttgcctgcctcctaggttcaagctattttcmtgcctcagcctcctgagtagctgggattacagcgtgggccaccatgcccggctaatttttgtatttttagtaaagatggggtttcaccatgtrggccaggctgggctcaaactcctgacctcaggtgatctgcccacctcagcctcccaaagtgctgggatttcaggcatgagtgactgcacccagcccagaattttatctataacttctaatctgagcaagactagatagcttttattcttctttgggtgggggtagatttcaatgagaagaaatattgcattaaactctaatttttatttaagttcttgaggtttgtttttttttttttttcaaaattatatcttgtatatttccaaggcagaagactatttggagaagtaaagtctgttgtagctaaagtattctgttgtgtggcagttgaactgatgtgtgcttccctgacatttacttggtaagtagttaattgcttaccaagttagaaataactgtggtatcagtaatacaaatacttgaatttagggaaaggtgagatactatattatgctaggtgaagtattagtggtacttagttattaatgtgggatttgtttagttagaacctaaaacaatattaggacaaacatctgtatgttcaaagatactagtttctttattgctgggtaaaaggtgattataaaaggatcatgacaggttaacacatttggcttcaatttcagttttgccagatctaggcaagatttatttgggcaacaaacaatacatgtaatcaattataattattcttattaatggtggggaacacagagatgtatattaaaattttatttaatttcagataaatgtttactgggaaaatttgaaatatatttttatatttaggttggatgcttacttaaaaagcaatgaaagagcatcgtgaagacatgaagatttcttctcctttcaccctatctccccaatcagtttcttccttcattaattgctgtttgagaattataacttggctctaaaacttaaaatagctacttcctctcagatattttctgcattgtgtgtctggttgcctatttgagtttcagagaatttcccttatggaatgcaaagtgaaaggtaaatagtcaattaagtagaaaagttactgtcaacagagatatatgtaaacatagcaaatacgaaagcaaaataatctggctttagctcttagggaaatatttgctattgctaaacctcaatttacatactctacaatgagtgttgattatctgtaatttgtgctctgaccctttaaaatttttacttataaaacttctcatggcatctagttgtattacatttttagtttctgtatctttatcttgtccatcaccaaagaggaattgaggtgaaagtttccagttgatgaatttgtcttccattgcttttaatgttacatgtttgtttagctttcctgcaaagtagtatctgtttatttgtttggagaccacatggcctagtggaccttagcattggatagactttggttggaaatccagtttggtttctactcatattaattagctataaaactaggataatatccagcttatagggttattagtaggattaagtgagatagtataagtaaaatagcatagtaactagtagatagtacacatggatttcagtcatcatcaacttttgaataatctactagattgacacaactaaacttcatcctctgctgtatttcaactttcatataataaatggtgagtgaggtattaagcccagcatctgatgcgctccctcctctcacctcccaccctccaaaaggcccagtgtgtgtttttctccaccaagtgtccatatgtttttatcattcagctcccacttataaatgagaacatgtggtatttggttttctgttgctgtgttagtttgttaaggataatggcctctagctccatccatgtccctgcaaaggacatgagctcattccttcttaaggctgcatagtattccgtggtgtatatgtaccacattttctttatccagtgtatcattaatcggcatttgggttgattccatgtctttgctattgtgaatagtgctgcagtgaacatatgtgtgcatgtatctttataataaaaaaataaaatgatttatattcctttgggtatatacccggtaatgggattgctggcttcaatgatatttctgcctctaggtctttgaggaatccccacactgtcttccacaatggttgaactaatttactcttccaccagcagtgtaaaagcattcctttttctccacaaccttgccagcatctgttgttttttgactttttagtagtagccattctgactggtgtgagatggtacctcattgtggttttgatttgcatttgtctaatgatcactgacattgttttttttttcatgtgtttgttggccgcatgtatgtcttcttttgagaagggtctgttcgtgtcctttgtccactttttaatgtttttttttttcttgtaaatttgagttccttatagatactggatattagacctttgtcagatgtatagattgcaaaaattttctcccattctttagattgtctgtttactctgttgatagattcttttgctgtgcagaagctctttagtttaattggatcccatgtgtcaatttttgcttttgtttcaattgtttttggtgttttcatcatgaaatctttgcctgtgcttatgtcctgattggtaatgccaattctggggttttcatagttttaggttttacatttaagtatttaatccatcttgagttgatttttgtatatggtataaggacagggtccagtttcgattttctatgtatggctagccagttctcacagcaccatttattatacagggaaatctttccctgttgcttgtttttgttaggtttgttgatgatcaagtgttgtaggcatgcagtcttacttctggtttctctaatctgttccattggtctatgtgcctgtttttataccagtgccatgctcttttggttactgtagccctgtagtatagtttgaaatagggtagtgtgatgccaccagctttgttctttttgcttagggttgtcttggttatttgggctcctttttggttccatatgaattttaaaatagttttaaaaaaattctgtgaagaacgtcagtggtagtttgatgggattagcactgaatctataaattgcatcagacagtatggacattttcatgatactgattctttctatccatgagcatggaatatttttccatttgtttgtgtcatctctgatttctttgaacagtggtttgtagatctccttgaagaggtcctttacttcctttgttagctgtattcctaggaattttattctttttgtggcaattgtaaatgggattgccttcttgatttggctgttggcttggctattgttggtgtataggaatgctatttatttatttatttatttatttatttattttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccatgttagccaggatggtctcgatctcctgacctcgtgatccgcccgtctcggcctcccaaagtgctgggattacaggcgtgagccaccgcgcccggccttatttatttattttttgagacagagtcttgctctgtcgcccaggctggactgcagtggcgcgatctcagctcactacaacctccacctcccaggttcaagtgatcttcctgcctcagcccactgagtagctgggattacaggtgtgtgccaccatgtccggctaatttttgtatttttagcagagacggggtttcgccgtgttgggcagtcatgaactcctgacctgaggtggttcacctgcctcagcctcccaaattgctggtattacaggtatgagccacctcactcagctggaatgctagtgatttttgcatgttagtttagtatcttgagactttgctgaagttgcttatcagcttaagaagcttttgggctgagacaatggggttttctagatataggatgatgtcatctgtaaacaaagatagtttgactttctctcctcctatttgaatactctttatttttttctcttgcctgattgccttagcaggaactttcaagactatgttgaataggggtggtgagaaagggcaagcttgtcttgtgcgggttttcagggggaatgtttccagcttttgcccattcagtatgatattggctgtgggtttgtcatatatggctcttattattttgaggtatgttccttcaacacccagtttattgagagtttttaacatgaagggatgttgaattttattgaaggctttttctgcatctattgagataatcatgtggtttttatctttagttctgtttatgtgatgaatcacatttattgatttgtgtatgttgaaccaaccttgcatcctggamatgaagccaagttgatcgtggtggataagctttttgatgtgctgctggattcggtttacaagtattttgttgaggatttttgcatcagtgttcatcaaggatattggcctgatgttttccttttttttgttgtatctccgccagattttggtataaggatgatgctgacccttcctctgttgcccagtctagagggtagtggtgtgatcatagttcactgtagccttaaactcctgggctcaagagatcttcccgcctcagcctttttttttttttttttaaagtagctgtgtgtaatggtgtgtgtctgtagtcctatctcagctgggactactaggtactcaccatcacacccagctaattaaaaaaaattttttttagtttgggtataatggtttatgcctgtaatcttagcctattgggaggccaaggtgggagaatcacttgattctagggatttgagactaggctgggtaacatagtaagaccgtgtctctataaaaaatttaaaaaatggccaggcatggtggctcacatctgtaattctaacactttgagagggcaagggagtaggatcccttgagcccaggagttcaagaccagcctgagcaacatagggagatcccatctctataagaaaaaatataatattaaaacaatttaagaataattagctgggcatggtggtttgtgcctgtagtcccaattactcagaaagttcaattactcagtgatccgtgatcataccattgcattccagcctgggtgaacaaacaagaccctgttagagatgggggtctcacttagtcgcccaggctagtctcaaactcctggcctcaagcgatccaaccacctcagcctcccaagtagctgggattacagatgccaactcccatgcctggccatttgtatattttaaccattctaattgtcatgtagtggtatgtcattgaggtttccattatggtttcaaaccctgatgactaaggaggttgagcatcttttaatacattttttggctctttgagttttctcatttgtaaagtgcctgttaatgtcttttgctaatttttctattggattgactcttttttttgttatttctgttctggctgttcttggccctttgcatgttcatgtacattttagaaccagaacgtccacacacagaggcatacacaaaagctattacgattttatttgggattgtattgaatctataggttaatttgaagagatttgaaacatttacaatattaagttttctggttgatgtttagggtatctctgttaattaatttttctccagtttctctaagattttatatttttgttggtgaaggccttgcacatattttgttagatttattcctagatccttgatagttttaattctgttgtaaattgtagcttaaaaaattcccttactgaattttgttgctggcatatagaaatacaattagtttttctatattttttattttttgagaccgagtctcgccttgtcgcccaggctggagtgcagtggcacaatctggctcaccgcaacctccaccttccaggttcaagcaattcttcttccccaccctcctgagtagctgggattacaggcgtgcaccaccatgcccagctaatttttttttttttttttggtatctttagtagagatggggtttcaccatgttggccaggctggtctcaaactcctgacctcatgatccacccgcctcagcctcctgaagtgctgggattacaggtgtgagtcaccgcaccctgccggtttttctatatttgaatccagaaacctgactcaattaggccaatagttttaataatttgtcgtggatacttctggattttctaagtatactaaatcatataatctgcaaatagagttttagttcttctttttcaatcttgatacttttttgttcttacctatattgtttttattcatggagtctcatttcctggtgtgctttgttactgttgtatgctggagattgtgtttcgaaagttatgtgtggactatattgaagcttaggaggattatatctttctggaagggttttcatttgttttttttttttcattggcctggggtcattgctggtccaggctaattttaatttaaatctgggatctgagatctcagaatcactagataagttgaaaatgggttgtagatccatgtgaaggctgataaggttctggttcatcctcaagtaattgttcacagctacaggaatttcaggggtttcttcctgactccattgagttttaaatttctgtgcctaaattttttttgtctatttctagaaatttttttttctttttcctctttttccttatataggcctaatcatctctgaaatgtcatttcttacattcatctaaacgtgtgtttggaacctgtttaataaaacacaggtttcatttattgatataaaacaacacatcacaaaggttttgtgcacgctgcttgattttaggtcttagggctggatgtttgtatgttcctgtaagggctcaatgggctcagaaatgtcatttcttagattctacaaactgtgtgtttggaacctttttaatgaaaacccaggttccattcagtgatgtaaaacagcacatcagaaagctttttcttcttcttcttcttttttttttttttgataatggtttgctgtgtcacccagactggagtgcagtaatgtgatcatggcttactgcagcctctaactcctgggctcaagcaatcctcccaccttagcctcccaagtagctgagataacaagtgtataccaccatacctggctaatgttttaatttttttttttgtagagatggggtctcaccgtgttgcccaggctggtctcaaactcctggattcaagtgatcctcccgccttggcctccaaaagtgctgggattatagacgtgagccaccgtgcccagccttttgcttttaaaaaaaaaatcactttttatagtttccacttcatacagattgtgcttgtcttttatttctgtacacatggtagcatagttattatctgtaaactttgtgaattcttccctgttgtttttgttcgtgaagtatagtttttttctataccttgttataaaatacaacgtgcttgacattgtatttggaaatttatttgtaggaatactttgaggtgtaatgtgaaggttcctccagagaggatttgagtttgcttttgcgaggtgcctgggcatttgaatcaggtaccgccttaaaacaagttcaaggcttgggattccctgatatcctacatcatttgagcaggaaggtctctcgtcagatatcccactttgtgtgggcctgactttgtatattaactttctgtgctgtaaagatgttttaaaaattttatcagtgttttgttttgttttgttttctctaggaggttgacccaaataatatagcctgttttactgaaacagcaagttctactgcagtttgtttaactagatacatgttggacatttagtttttttctttattattataaataacactgtaataaagaaacgtttttatttgtgtgcttgtcctgttatttacttgtgattaatctgaaaataaaatagttacaatctgcatttttaaaggctatttgatatgtattatcaaagtatggtacacaaagattgtcctaacactgtgtattctaaatctttttaacttttaccattttgatagatggaaaatagtacacattattattttaatttagcatttattatttttacttatataactattggctgttcatgttttactacttttgggttatgaaagcttacatactgccaactaggggcttactgaggctaactcacacatcagatgatgtaaatatttccctcagtttgtcacttatatttcatcttcatttacaaaaatatatatatgttttggtatagaagtttaacgcttgtactaatcagatctatcaattttttataaagccataatcagtctgagataataaatttatagttgttcctagaaaaactagtgttttaagtttggaattgtcttatgtggctagaaaattgagaaatagtcaaaccactctaacctcaattaggatattttaatatattaacataactcaaattaggataatgctaatttttagtctatgttaacctgagtttttatgataagttttttcctttttctcattaaaatattttctctttgtctgctactgttcttttgatgtataccttcagaaattggcagggttgaaatctgaaagaatattcaatgtaggtttttttctgtattttgccttcactaatgatagtgattcagatatcatgttagaaatgatttgagatatcaaggttttaaaatttttaataaaagtaaacagtattcattaaaacaggaaatcattttattgaaactgaatgaggacttcaaatttttgtaacagcttaaaatatgtttttttagataagtgatgaagagaagactcttcgagaacaggagattgttgcctcatcaccaagtttaagtggacttaagttggggttcragtccatttataaggtatgtaaacatgtaaaatacttcctaggttttgttaaatatgtcgcattgagctttatatacatatttaattaatccatttttatagcctctcatcatcacagctactctgtctcctgcacagatactgtcctcattgcactaatggtgtgccaatgttctctcctgggctgtctccttccacggacgcattcccaaccctgcttgggctctgacctcccattacaggctgttttcctaatggaataccctccttgcattgtttgggttcttacaccctgcactgggctatcccctgccaggaaaccctcatcacccatttggcccaacactctgtttggattgctgccttgcgtggaagccccctttcgcttctcttgacctctgacatcgtggtgtcttgcctcatggtctctctgtgattccactgggctctgacattgtaagcctacgttttttcctatgggaatgccctccttaacctactcagattccatcatcctgtgcttggccacctcagtttcccctccccactcagttcagataactacgtcacatgaacccttccagaaggggaagagggaagagtttaaattcattttacaatttgataactgcaaccccacaatttcctttgaaaagaatgtgctaattattatgagtgagtgccagtagtttaaagtcctgccccattccagcttcttcgtttcgactgttgggccatcattcagtcagcctttcaagcctagagtgtggtgatcaatatttatttctcttacaccacacatttccagttactctgccttcacatcatcttttgcttctacttgggcatttttgtttccactgtgaccaccttaataagctagaatcatgaaatattatggctaaagaatccctaagggtcagttagcctatctcttcctcccctctctcagctttacagatctggctgctgagatttagaggcattcattaaattcaccaaataagtctagtcagtatcagagcttggactagaactcatgtttcttccctatattattgcagtaaaccctcttacctgctcatctaatatgtcctatgtaagctacctatttggtgcagtatcacacaattctaccctgtagggctgtttgactttccggtgtgtgcccatgagggcagggactg

SEQ ID NO: 10786 - DNA, 23780 bp, Homo sapiens
  misc_feature (1)...(23780): n = A,T,C or G, or insertion/deletion polymorphism (see Tables 1-2)
agctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggtatggggtggggctcaggacagggaaggaggatgggcaaagcatagacaggctggagaaaacaggagtatctggagccagccccgggcctttgtggggatcagattgtgggcctgccatatggctctgaatgagtaggtgttcccagccatccctttgtgatctgggagagtccagcaggcaattgcagtggaggatacacatcttctttatctgatcctctccccactgccttcacaccctccccactcataacaggatgatgacagcaactttcatatggatttcatcgtggctgcatccaacctccgggcagaaaactatgacattccttctgcagaccggcacaaggtgaggggaatctaaatctgatgttccaccctcctccaggtttgagttacccacacttagcccctctgtagaccctgaggctcttgtacttaactaccaccttcttttgtcccttctgtctctcagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccaggtgggggcctgcatccgaagcagggtttgggtggggtgtatctgtgtagatctggttctgattcacgtcataccctgtcaccaggtgagggtttctgtctgtgtacctaccctttttgtgtatcctttttcacttattcattaatcacattatttgagtacgtgcgaaaagatgggatatttgaattgtgccctgggagattattagtaactacacaataatggcagccaaaatttattggacgcttcctacacttaagtgctttgcttgcttcattaatgaattcactcaaatatttattgagcaccttttgtgtgcagggactcttctaagttatgttcctcaagtagattatataaataacctattaaatgattttggaatcaaaaaaggataaaaagaggccgggcgcggtggcttacgcctgtaatcccagcactttgggaggccgaggcacgtggttcacctgaagtcaggagtttgagaccagcctggccaacatgatgaaaccctgtctctactaaaaatacaaaaaattagccaggcgtagtggtaggcacctgtaatcccagctactcgggaggctgaggcaagagaatcacttgaacccgggaggcggaggttgcagtgagccaagatggcgccattgcactcccgcctgggtgacagagcgagactgcatctcaaaaaaaaaaaaagataaagaggacttgagaataccagggggcgaggggatgtatttgagattttgtgtaggatggtcagaaaaggccttgctgaaaagatgacatttgagatcagacttggaggatgtaaggggacaaactgtgcaggcttggtggcgagtggggacacattccaggcagagggaccagttcttgaaagggtaccaagataggggtgtgcctggcaagttggaggaattcaaagtccccagagtgagtgtgagattgaggagggtaggagatgagaagaaaacagaatttcattgcttagggtgagataggaaccacaagaggatttcgaacaaaagagggttgtgatctgactaaacacgtctgcatgggggtaggggggatggagacagatgggggctggaccctctgggatggtctccatcttacactcccctctttgtcttgcagtactataaccaagagtggacattgtgggatcgctttgaggtacaagggctgcagcctaatggtgaggagatgaccctcaaacagttcctcgactattttaaggtaaggcccctcccttactctgtcaccccacctcagggggcgaggtgtacacggtgacttgctggcctgtccacctccatgaccctgctgttccccctccctctccagacagagcacaaattagagatcaccatgctgtcccagggcgtgtccatgctctattccttcttcatgccagctgccaagctcaaggaacggttggatcagccgtgagttggacactggccaggctaggggaggccctgtatgggttggggagcctcatcatccagctgtcccactccagttcactgcccctacctacctgcccatcctctcttgctttctgccctcctgaccctatactcccatccccctatccccaggatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccacatcgcctgccctgctggttccagggaaggaagggacttcctggagctgtctggttcagatgataactcagagggctcaaccccaccacacctgccagttttctggacaaagaaaatgtaattgccacctcttcctgccctctctgcctaggaagagatggaggcaccagtgaggccatagtgagcaggtacttgggtccatgtgactgttaatttgagctgggttcaattctcaccttctccatgtcctaactccttgctctgtgaagaggaaagttacggtgaccaggctgctagggcatggccagcgtgccttatgtccttagggcagatcccctcccacctggctcaaagcactcagaccctgggcagccttttgtggtcatggttcccagcaccaggaatgcctgtgctgctcttagttcaatttccttgctgcaggggtgtcttaaacagctctgccgaatgccagtgcctgcaggcatacttcgtgatttttatggaaatacttgagaacatctgtagaggaaaagcccgttgcttgccttacgcttcccccggccctgccgccgccccagccccaggtctgcctgtattccccttgaggatcttcagcctcctactttggagaagacagctggctgtggggactgaggggtgttcatcgcttagagcaggtagcaggaggcctaacaccagccccaccgggactgcagagttaccgtgctctgtccttggtcttggctgagtgctccagacaattgaaagcaccagtctggccactgctacatctttgccttcttctattgtactggctcctggtgcctgaggagtccattcatacttctgttcctcaactaaccaataatttatctaccttacttagaaacaagatccctcactcttctactcaaacctgagtgtaaggaatagctcaacctgttctgaactggcttgattcccatcacagcctgtgcccacatctgctgcctcctgggccagtagttcctggtcctgggcacagtatatgcccttgtccacctccttctgatcattttattttcttggcctgctctgcttgggtgaccttatccttccacagtttcttcttccccactaggacgttgaggacagaggcattttccctttggtatctagtggtgatactgtcaaagggaaagtttttcccaccacaggaactttcccattattgctctagagtaccctagacactccacaccgcagtccactggccacaccactacagcagctgaggcttgaacacaactgttgtcttctttctccagtatgccagctcctttgcggatactctatagacaccttgttcactgcacctcccccattacggctccatgtcttccccaccacaactcctggatctccttgacaccttattcgtgcctgacacccttctccatcaaaacaagcttttgagtcatgcatgaatcctggttgcatcttagttgttccccctccacctcattccattttacttctgcggtttgtctaccagtctaccattgttaacaccagccagatgggagatcagggcttagcaggcgggggttgcgtcattgcaccgagccccctgcacccagcagccacaaaggatagggtgggacaaaggtttctcttgtcactgcctggaactatttgcccacctccttctgatcattttattttcttggcctgctctggcaggcattcaacaaacatttgttgtgtgctgtgtgccagtcactttctaggcacgtgagacagcagtggataaaacaaagatccctgtcctcttggggttttacgttctgctaggttgacacccagaatagattataaacacagtaagcaaattgtaccttagaagttgatcagtgctcttcaaaaggcgaggaatagagcccgatctggggatctggaatgatggcagtgcaggtaggaatttttaaatcggaaaggcttcatggagatgactttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcggagtgttctacttgtgttgactgacatcaaaacaaaacaaaaaaccctcagagtgaggggaggcacgggaggggctgtgccgggcaagagaggtggcaggaaaatccaacgcacggcgcctatgcaaatactcgtgtgaggcagaaaagaggctccgccccgctcgaagttccaagcatgcgcagtagcggctcctgcgcctctaaggatccgcctctttccttctttctcagcctgggttccaccccgggaggcccgctgtatgagatggagggcgggctaaaggcgggacgagactcgattgagcgcaattatgaccaatcaccttgcggaatattcggcctatagcgaaggaggagctcagaacaaaaaggagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcwtctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccrctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgtctgagacccccatccccctttctgggagtgttatgtgatatacagattttacaccccatcttcctaaaatcccaaaaaactgaactccagagcatgtccagcccttggggtttccagttagaggtcgtggacccatggctcctcctggcttcctccccatcctccattcagccctacttccagtctcccccagcccctcccctactccctgtcacaacatgcaaagcaactgggtatctgtgccatatggggacacaaggttgtctttgggagctggccatgctttaccttccttgccttaggcccagtattcagcctcccaggtcaggatgttttgtggttatcctgggttctccatggatggacctcatcctgtatctgaggtctttctgctagggtggcccctacccctcctggggatagtgagttcagccaggtgggggcgagaactgctgggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcycaagaggaagcagaagacggctggcctaagccttttggtggccccattcccttcagcaatccatctaggtcatcttcctgtcgatgccagcatccctggrctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaacckttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccaggtgggtccactggctatcccctctcccatatggccccaggctgcttcccaggtgttgcctcctggtcacattcctcattttcctctaaattttctgccctttctctgccccccatgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcrctaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcanacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtgsaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacngggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggacccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttktagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggamaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttktttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaaacactgggagtgggccagggacacgtcacgactatgaaaaaggcatctaaggtattgcatatgtaacagtagaacatggagttgaagcaggtagggcaggctgaatggtgttgatgggttgagaagcagaaaggggagttagatttgcccaggaatatgaggaagcctgataagagggtggaggcagggaagtggagagacgatgtttgaaagacactggacggcccaatagaaccatggatgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgagagagtttgcaagaggccagggatcaatgacacaacctggggtttgccctcagatatgaggataattgaaacttattttctttgtcctgtgagttccagccccagtcccaccatcttgggcaaagccaaggattgttttctaagcagaagagggggtgagcagggccaggcaaatactgcaagtaatggcaaccctaattaagtggctgtttactaaagcccagtggtgggggcccatgaacttctaatcactctactgtgtgtgtttgttttttgagacagagtctctgtcgcccaggctggaatgtggcggcacaatcttggctcactgcaacctttgcctcctgggttcaagcgattttcctgcctcagcctcctgagtagctgggattacaggcgtgcacaaccacgcccacctaattttttatttttagtaaagatggggtttcaccatattgaccaggttagtctcgaactcctgacctcaagtgatccacccacctcggcttcccaaagtgctgtgattacaggtgtgagccaccaagcccagcctctaccgtgtctttctaagcactttagtgatgtttcagcttgcagcctcatggtgccatgatgactgccatgtccccagagatggaaaagcaagcagggaagacagaacaccttccttacctgtctgtgttcttttaacggctggaacttccacaagctcctcagcagacttcctgtgccatttcttggctagaatcagatgacatggccacttctggcagcaagggaggatgggaaaaggagggccttgcaaagggggacaggattgccaggctggatttaaaaggtctagaactcacccaactgctctgggaagtggtagggtcactggtgtgggcagaggttggcctctggaaggtggaaaaaaaaaaacggtctagggctgggaaaggaggtctcttggatttacctggctgcccagataaatggggagggggagtctgcagaggggcaatggggagaatcaattcagagaatctgacaagattcaactgggcttgaagagcagctatctgccatgtgtctgactcaactcaaatgccactttctttggggacccttaagtgaaaggcctgctccctttcctcacccagagcttacacaactgagtttgtgacccctcatctatgccaggtctgggctgggggctggaatcacagtaataaagacacaatccctgccccgcagagattaactgaaaataggtaaattatgaaattgtgagggggaagggaggttcgaaattaaagtcatcatcaacggggctggcagccccagcagaggaaagaatagcatagcctagagcagtggttctcaaccagagacatttttcccccaaaggacatttggtaatgtctggagatacttggttgtcctgaggggtactacttggtatctagtaggtagaggccagggatgctgctacatatcctgcaatgcccacaacaaagaaatgacagtgctgaggttgagagaccctggcctagtccaagggttctcaaactttgggtctcgggattcctttatgttcttaaaagtttaagatattcaaaagagtttttgcttatgtcatatagcctctggattcagaagcctctggataatcacactgtacacccctgagagaatgagagtgaaaaagtattgtgaaaatagttttcattttgtgaaaccccaagaggatttttggaccggtagacaggctgggaccactgggaccacacggttggagaatgtttggcctggtgtttaaggtcacagctctgaaaccagatttctcaagtctaaactgcagctccaccactaattagctgagggacgtttctggtactcagcgtccccattgttacccatgggtgacaaggacagtacctgctgcctgaggctactattttagtccaataaagcacttaaactgggcggacagctagtttagttatgattgctatgactccaacaaacatagggcctggggctaacttgtcttcaacaccttgtctagtgaataaatctagttcaggaagagaaacaacagcccgcaggcctcggtgggtctctggaggtggaaacctcttttgcattgggttttgatggtacaatgaagggcattctgatcaggctaacaaaaacactgctcccagggtaggagtcctagcccacctcgggaacctcagcctccactttccatgccacctgtgccctaagtctacagggcgttaggaccccacaaggcacttttgtctttcttggttcccactgaagattttaccccacctagcccttcgacgcgtctgtgcacggggccatttccaatatggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggtgaggctgggctgcggtggagcctcggcagagggaacggtgggggcattgacaaccgctggggattcggcggccgagggccgcgggaaagctgctgcggggtgcgggggcgggggagtggccggcgggacagcgggctaaaggggcggggaagtgcctttgaatgaatcgcaacgtctggaaaaggggcggggcctgtgtggtgcagtctgacgcctgagaacaaaatggggtttgttgtgatgagaccagtttcggtcctggaggtggggccgggcctgcgtagtgaaactgcgtaggaacctgggaagaaggtgggttctgctacataaggcgggggcgcggcctgcgctgcgtaatgcaacttttgggggcgaggagcggtttccgattgctccggggcggctgggaacgaggcgagctttgtgacgtcagcagaagagcgggatggagccgaacggtccgagggagggagcggggacctccgtgggggaggggggaggagcctggagcctgggaacgaggttaggttggtgacgtgagctgaggcagaaaatggcgcctgcgaataagcaaagtttatgacgcgccgtggtttttgattctggcggaagccttcccgagtcgagagaacgtgcaggtgattagcaccggaggggccttccatgtttaattggttttctgtgttggtactgttttgtttttagaatcaagaaaaagtcgtttttttaaaaaatagaattttgataaatcggcttgttttactgatttcttgctaaacagtccttcttgaaatttactgcttctgagttcattttatttctcgccgagttgcatctcgttttttaattgtgaaatacgtaagacttaaaaagattatataaaacatttacgcagcccagattgacggacatcctgttaaaataaacggcctacactcttcaaaaatgtcaggatcatgaaagacaaaggctgaagaactgttccaaattgaaggaattaatgcaatttaacgagtcatgataactaaatgcaacatgtgatcctcgattggatcctggaacagaaaaaaaaattattttaaaaatcaattttttatcataagattatttttgtctcttttactgtaaaaggcaatggaaacgtcggtgaaattttattaaagtgggtagatactagtactactaataattgtgatcattgtggctgtgaaaaataatatccttgtttataggaaatactgaaaaatttagggataagaacgcatcgtgtaagcagtttattctcaaatgcctgaaaaattagcatatataaatttatatatggcgaggggaaataaaattggggagatgttggtcaaaggatacaacatttcagttagacaagaaaaataagttcagatctattgtacaactatagttaataaattcattgtatacttgaaaattactgagagaagattttacatgttctaccaccccccaaaaaataagtatgtgacgtaatggatgtgttaattgccttgacttagtcattccacaatgtatacataagtcaaaacttcatgctgtacactctaaatatatgcaatttttgtccattttaaaataaataaaaataccaaaaaatgcatgtaaagaaacaacgattgagcaaatgagtaaaatattagatttggagaatctggatgaaggacatatggggattctctgtattatttttgccatttttctcaatctatttcaaagtttaaaaattaaataataaataaaaacgtgtgaattcaccatccatgttaagattcagaacactgtcttaagaaatccttctgtgcccctcccagatggaaattcccctccttgctccatgggaaactgttatcctgaattttgagttaacagtctcttccttttctttaatgttttaccacagctgtatgcatccctaagcggtatgtattgtctaagctttcactttatacatatatggaatacatatatataaaattctactggatgcatactgtgagcccttatcttcgcatcgggtaatacatggtatccacatggcatcattggtgatgttaaccttgatcacttggttatggtagtgttggccagctttctcaactgtaaaggtaccattttcctctttacatatgcagtaattatttttaaaacatgtatcatgtccagccattcctcaaaatactcttaacagcttcccatctcttgcagcgtagatgctaaaatccttacaatgaattgcaagcctttatgaagctggtctcctgcttgcattctgatgtcttcccatatctctcctctgattacgcactccctccctgtctccatccaggccggccatattggactcttgctgttcctcaaacacatctaaccttagggctttttcgagtgaggtttactcactacagagttctttaataaccacaccagtgaaatgtgtatctctgttactggggagatgagttgagattttccaaatcgggaatacaaacccaagccgtgtttttctgccattacgtcacacttttccagcaagaaaaagcctcatttcatcctgagaataaacaaaataaccacagtgttttgtaactcatttgaagatgttcaaaagggccttgaggctttgatccttgcctcttcctacctttgtagccttgtgattgtgtcactggtaggacatgacatcctgtcatccttgataatacgctttaaaattaccccaccagtactgggttttcttttgggatgatgaaat

SEQ ID NO: 10787 - DNA, 14096 bp, Homo sapiens
  misc_feature (1)...(14096): n = A,T,C or G, or insertion/deletion polymorphism (see Tables 1-2)
ctgtcatattcagagaatgatataatgtgtcatggccaagataaatgagaataaaatctaccacagaaacagatcaaaatggaaaagacagatatttccatataccttgaaaaggcatttaataaaattcagcaatcatgcttgatttaaaaaactaaaatttcttaacaaaacatgtgaatgaaatacttcctttaaataacaatgtatgtgtatcccaactcaacagccagctcaaatgagaaggccagacacaatgcaaagatgcaaagacaagcatatccatcattacctttgttaatataaagctgatataaaacaaacttttaaaaaaaatctgtgatatatatgatatacaattaatttcctgaatgtataaagaacccttcacactgacaataaaaagaccaacaatctaacagtaaaacgggcaaaggactgaacaggcagttctcaggaaagataaatacaagggttgctgaaaatgttgaaacatgctaaatcacactcctgataagagaaaggcaaattaaaattataataaaatattttcacctctcagatttgcaaggatcaaagcatataagacactgctgacaagctataaaagtggcactcatatgttgtcattaggagtgtaaacatgtattatctttatgaatagcggaaatacccaccaaatttggtggatttaaaaattttaacctttaacaattcttataggaatttattctatagatttacttgtacacaagagaattgatgtgtatgaggataatcactgcaacattgttcagagtcattatgtccactaaagataactgattacataaattataggacatccataaagtggaacactatgcaggcatcaaaaagaaagataagctggcatggtgatgcacgcctgtaatcccagtactttaggaaactgaggcaagaggattgcttgaggccacgagttccagaccagcctgggcaaaatagcgagatctcatctctacaaaaaaaaatttaaaaataaataaataaaattaaaaataaaaaaatttagccaggtgtggtagcatgctcctgtggtcccagctactcaggaggctgaggcaggaggatcacttgagccaggaggtcaaggttgcagtgagccatgatcacaccactgtacttcagcctaggaaacagtgagactctgtctccaaaagaaagaaagaaagagagagaggagagagagagagaagctctaaacaatatagttatgtcaaatgacttctaagacataaatgccaaagtaacaggcaaaagagtgtgctaccatgtgcttaaagaattcatggatactctcacaaagtatacatcacacctacaaatctccacaagaaactgacacagggatgcctctggggaggggaactgagtgatgagaaaggtatgtgaaggagactgcataccatttgaaccatctgaatgtggtaccataagcatgtctaacaactaacagaaagggaaatatacacacacaaaaaaaaacataaaatactgactggttgtgaagtctttgtagaaagatttactagtcctctaagcagatgaaagaaatattaggggaaacattgcttgttttcattacatccaagttttaaacattctatttcaaataacaaccaaaattaaaacagaaagaacaaagaataaagaagactgagtgacttttgttactatataaagaatctacacaagaatttaggggggaaatgttaaacacagtaagaataaaaggaattacttcaaaagcatcccacccacaaccagcaaagacctaggttaagcaagactatgtattactggtattttacatgaaatacagttataaacattctcctgaagaggatagaggcaaaatgacaattagagttttagaagaaaaaatactggcaggataaatattttaggtgagagaaatattcaggcttagagatttagaaatgaactatggcacagagaaagtgacatacaaaaacatatacaaagtatacacagaaaaaaatgagagccaagagcaaaggacagtagaaaagacaaataaaagaagatccctaagaaaaggaaagaaaatgcttccccaacaatgtgtttgccaaaaatcgcaattacctgagagctaaaaaaccatgcttatgtttggaatctgcaactaccaccaggaagtggtatatagtgagttagcaagcttccatgagagagtgggtaaggaatggaaaatgaacatgggccagacgtggtggctcacacctgtaatcccagcactttgagaggccaaggtggaaggaccacttgaggccaggagttcgagaccagccgtgactaatatagcgacactccatctctacataaaataaaaatttaaaaattagccaagcattgtggtggacgcctgtagtcccagctactcctactcaggggcctgaggcaggaggacggcttgagtccagactttgaggttgcagtgagctacaattacactccagcctgggcgacagggcgagactgtctcaaaaaatataaaaaaaagaaagaaagaaaatggaacagaagtagaaagaaacaaaagatacctggtgaatgcctggaaagagagagagaaaaatcacataaagagcttgaggatttcagaaggctgggagatggcacagatgggcctgaggccctcaggaaggcagcagccctcccaagtgcagaaagactggggagaaaagcggccagccacttgacaggaggatgacatcaaaagaggaaaccagtgcctttctgcaccaacagggcactcaaagatgagcttccactcaggaacccccgtactgctccgtgtgctcagcttctgctgggatgttccccacccactcacctgcatgtgtgcctgatggagcctctcgcacctcagtccagggctctgccccttgctccaactgagtaattagttttggtttggaagagagaagccctgttcataaagaaaaaggatcttagaggaagaaaaaaaaaatgaatgaaaaggaatgtgatggcggttacaagcacaagcagtcactccagacctcagtgtcaacttgagcatctgcaatgagcatggacaggtcagagaggcctagagggtggcacccaggatgtccaactcatgaagtaaagcaaagggagggggcaaagtcaactagaaaaccaggtcctcctggaggacgagaaactcctattttgggaggcagatgaatcatgacacagaaacattccagaactgggctagttggcaccacaaagctacccatcttaactctgtatggctctgacctttcttgaggggtgtaaggggcataaactccagcctctaagcccatacttaagaaaaacaaaacaaaaagcacatcatttaagattttttcaataccccaaaccattcaccctgtgaaaacacaaagttgcccagcagaccaatcctgagtcaaggagaaagccatcctcacccacagacaccagattcccatagttctccagcatcacatccctgtacagggcccgctgagcagcatccaggtgtctccactcaatccgggtaaaggccacagccacatccccaaatgtcagcggtccctgcaaaaccaaacccaattctgctcatccgggaacccctgagggaggcatcccaagagaaggaagcaaggtggtcaaagccagcttctgacagttccaacagtgctcatggaaaccaacaagtaaaagctgagggctgaggggatgtgcgactcctcccttgagcaggttcttcctgcatgcctgtcctgctccctcctccaggcctagcctctgctcactccacccttcatgtcacctcatcaaaaaggtcttctatttctccaccccatcctctgccactcagtctcgaaacccatttcacttttcttcacaggatttctcaccacctggcaggagaggtttgcactgactgtcagcatcctctctaatgtgagctccagggggacagtgtgggtcactgctgcctcccagtcaaaaacactgcctgacacagaagtgttcaggctttattcaatcaacaaatgaatagaaactttgaaaagacatggaaagtgattagctttatccgagaatttacagggagtatgatctgactctggggcagaatatttttaaaaaagaaaaaaaaattgcttttcataagagtaacaacttactatgtaccagccacggtgctaaaccctgagatacatatcatctctctaaatttctgccgtaactatataaagtaaaatctatttcgtagctaaagacacaaaggttcagagagttggaagaacttgctcaaggtcccagggctggttgaaggcacagtataaaaggaagccacaaaaagtggtaatgaaactagaacaaattggaatggctatgaaatactaaaagaaaaaatgagtaagccttaaaaaaatgaaaagtgtgtttcaaatgaaattacttgacttagagcagtagaaatgtaggtgatctttaatttttttaattttatttgtataatagacactcaaatgtttatcacttcctttcaaaataccaattatttaatcagcttctcaaaatccttcaaaacctagttttctccaggataaaagcaaactccagtctgggattctagaccatgaatgtttccaactttctcagaccagtttgttcatggtcccgccataatgacttcattcaggcagcgctttcccctagtatcctctgcaattatgcaaatctcatttattcttcaggaagaactaaggcgcccactactccacccctcccaccctaccacacactaaaggtcaagagagcactgctatcaccctatgtctttatggcctacgtctttacatgctaacgtgtatttttttcatcgtctgccagtttgcaaagcacttttctgtttctagcactctagaaaacatgggtagcaataatctacttggtgaatgactacgtaatgggtagacaggacggaaatcgcgggacccatccaggattggttcgggtagctttgtccacacacagggcagggcattgtccgggcaagaggcataaaccccacctcgctgaaacacgtggtttctcaagaaatggaaaaatcaaacttgcctggatctgggctcttggggccatctgtctcctgaactgttctcccaggcaagggctgagaatcctgcgtaagtcaatctgggaaagaagagaggaaattgaggaagtccctccgtgccctagcctagctagaatctgccctctagaccaggtccccgcccgcccgttccctccacaggtgggcagacaggtccaggtgggtacgctcgggaagaaaggaaagggaacggctgctgggatccggcctggactgcagccagctccacgccaaacacttttggcagcaccgggggacggccttgtcagtggcccaatctgtcggccggggcgcaaggctggagcgctctgtgatgcaccagcctcgagcggtcgctccacacggcgcagccactgcgggtgggcactgcccaccgccgccttcccctcccaccccggctcgcccctcgacccgcccctgggaaaggcggggagcacccgccaggggctcgaggcttcagggacccagcctgaccccggccgctcacgaaccgaaccgagccggcagggctgcggagctgcacgcccagagagtcagcgaccacaccacgccgttcggacagtaaccaccagccaggggctggtgcagcgctcgcaccacgcggagacaggctggaccggaagcggaagtggctgaggccgcggaggcctctgggaaacgtagtctgggccgcttggggtcttaggggctccatccgcagagcaggttggcatcacctgggaatctttgaaaagtgaaggtgcgggaagtggagagcggctgatcgcagtcgggaggtgatacattatgactgacatgcaaaatctggtaaaaaattggacagggcagtgggccgcctggaggcagtatcccatacctctgacatgcaccgtggatatggagatagtccttcaaaagcaggagcagctccayatgcgcaggcatttgactcgctgcttgcctgccctgtggcagagtacttgaagatcagtaaagagattggggaagacgtgcagaaagatgtggagatggtacacacagttttgaagttggagtgagctctcttggttacagcttctcagtgtcaatagccggcaggtaataagctttccgatntgttggcacctatctcagagcagatcaaagaagtgataaccttttgggagaagaaccgaggcagcaagttgtttaatcagctgtcagctgtcagtgaaagtatccaggccctaggctgggtggctatggctcccaatcctggcccttatgtgaaagaaatgaatcatgctgctgtgttttatacaaactgagtccttaaagagtacaaagatgtggataagaagcatgtagactgagtcaaagcttatttaagtatatgcacagagctgcaggcttacattaaggagttccataccaccggactgcctggagcaaaacggggcctgtgacaaaagaactgagtggactgccatctggaccctctgctggatcagctactcctcccccaccaccaggcccccctcctccactagtctctgtcagttcaggctcagatgagtccgcttccctctcagcactgtttgcgcagattaatcagggggagagcatcacacatgccctgaaacgtgtatctgatgacatgaagactcacaagaaccctaccctgaaggctcagagtggtccagtacgcagtggccccaagccattctctgcacctaaaccccaaaccagccacaaagaaggagccagctgtacttgaactggagggcaagaagtggagagtggaaaatcaggaaaatgtttccaatctggtgattgatgacacagagctgaaacaggcggcttacatatacaagtgtgtcaacacgatgttgcaaatcaagggcaaaattaactccattacagtagataattgtaagaaacttggtctggtattcgatgatatggtgggcattgtggagataatcaacagtagggatgtcaaagttcaggtgatgagtaaagtgccaaccatttccatcaacaaaacagatggctgccatgcttacctgagcaagaattccctggattgtgaaatagccagtgccaaatcttctgagatgaatgtcctcattcctacagaaggcggtgactttaatgaattcccagttcctgagcagttcaagaccctctggaatgggcagaagtttgtcgccacagtgacagaaattgctggataagcgaagtgccactgggttctttgccctcccttcacaccatgggataaatctgtatcaagacggttcttttctagatttcctctacctttctgctcttaaaactgcttctctgctctgaaaagcacagctacctgccttcactgaaatatacctcagatgtgcagtgggatagcaggtcagttgatcttctgcaggaaggtgcagcttttccaaatcagctcaactgccgacgaggactaatgatgcattttagctttgagctttgggggttattctaccaacaaacagtccactgggaagaaaacagtcccaggaattaacagatcagaacgttcacactggttaatctttttctgacaatgagcatgaaggtagcagaagctggtgtgtttccagatggttcttctaaccaaactaatttttcactattgacaagtgaggcaaggattgcactggaccaaaggctgaggcttggccatctagcattccacgcaaaattgtttcctataagcattccttttattcactattctatcctgggtctgcctcaaccatgagataggagagtctccrgtactagctgytgtagcagtgcccttcatccagggcagttaaaggagtattcracccttkctttctctgggatccctgcccagcaccttcctacagagatgaaaaaaaaaaaaaggaaaaacaacactccattccaaggagtctggtattcctgaatcctccttccctgctaggtgcctgtcacctgtcttcactgcctccttttccctgtcacactcaccagcttatggcttctgtccaagcacctgaacaggggaccaaaacctccactgcaagctgcttttaggtcttgatttatgtaagaatcttgcacagcactgctaatgtaaatttcagttttttccctctaggacaaacacttaccaaaatacgcaacttttttggtgggaagagagattgtcctgtgatttctacccatttcctgatcctgtggaaataaatctttatgtacttaaagttatacagaaaatagaatgaaataaataccaaaaaaaaaaaaaagcaaagtgaaggtacctgggtcccagcttcagagattctgaattaattgccctaagtgtggtcctggcattcggattttttaaagcccccaagtggttctaatgtactgcttaggttgacatctgccaccagaaactgatacggaaagtatgagagacatattttatgtgcctttggatagctatttgtttccaaataatcctgtttttatttcatacaaataaaaagcatgttagaaaagtacatcacctagaacactaaaaacattatttcctcactatttgctgacatagaaaatgaaagtaggttgaatctgttttaacaaatgtattattttctaggaaaaacatatgtttctatttattaactccaggaattggaaagctaagggaggaaaatgtatctctctcattcaattagggcctttttttttaagaaaatttctcaggatggtgcattcatttaccaatttaccagtgattgaccaaaggcccactgcgtgctactcacttctggatgctaaggatagaacagctgacaagcgtccctcctagactaaagtggagtcaggctcctttgcatcctcctttcaactatgccttgtcttggcctggtgagccgagttttagccaagaatcctacaaagccactttatcaagaatcatggccaggcatggtggttcacacctgtaatcctaggactttgggaggctgaggcgggcggattgcctgagctcaggagttcgagaccagcctgggcaacacagtgaaaccccgtctctactaaaatacaaaagaaattagctaggcgtgacagcgtgcgcctatagttccagctactcaggaggctgagacaggagaattgctggaacctgggaggtggaggttgcagtgagctgacatcgcgccactgcattccatcctaggtgacagagtgagactctacaaaaaacaaaagaatcacactttttccatcacactttttccatcccactttttccagcaagggcacctaaggaccagtctttccttactttgggggctggatccagaatctgcatttatttatatatggctaccatttgctgattccagaggacatgcagagccttttacatacatcattacactgagctctcaccaccaaagaaggtacaattattattctcattttgcagatgaggaaattggctcagagaacgtaacttgtctttggtccctcacctagtaaatagcagagctgggtaccaacagtcattgttggatcccaaagcaaagttgcccccattggctttccatcatccctcgactgtctgaactccttgcctaacctgctgggccctccaccctttcctgcctgctttgccatcctcacctctccctcggccagagctcatgtggctctgccccagcggcttccttagccccttgctcaccaagcttcacaccacctagggagctggacccatgcaggagctgccctgggctcttccttctgcttgcctaacttgggcccccactcttgtcctggccaactcctctccatccttcctatctgaactaaaatatcaatttcacttctgtggcccaagactaagagacatcctctcttagtacactccactataagtgctcctgtgtggggcttgaacaaagtgtcaattgccagtggacagatgtaggcagagcctgcaggagttacgtcaatcatttgaaaagaacattatttactgataatagagattaaggactcaaaatggggtgttgggagcaagccccccaaaatccggccataaactggccccaaaactggccataaacaaaatctctgcagcactgtaacatgttcataatggccctaatgcccacactggaaggttgtgggtttacgggaatgaggacaaggaacacctggcccgcccagggcagaaaacagcttaaaggcattcttaagccacaaacaatagcatgagcgacctgtgccttaggacatgctcctgctgcagttaactagggcaacctgttcctttaattcggcccatcccttcgtttcccataagggatacttttagttaatttaacatctatagaaacaatgctaatgactggtttgctgctaataaatatgtgggtaaatctctgttcggggctctcagctctgaaggctgtgagacccctgatttcccacttcacacctctatatttctgtatgtgtgtctttaattcctctagcgccactgggttagggtctccccagccgagctggtctcagcaatggggagttcacggtttcaatcactaccagctaaaacttacaaagagacaggctctgtgctaaatgcttaacttcctcacttctttagccagttggcaatgtgaaggggatggtgtaatctgtccccatttttcagatgaactcaaggccaagtggagatgtggtgctccagccagtgggcagcaccaaggctggcaagaggctgggccaggatgaagtttggacctttccctgcaggcaatgggaagccttggaaggttttatacaggataagacaggaacaggcctttttctgaaaagaccacccttggggggcctggggtagtgagaactttaagggaagggactcacagccagaaaggtaaggagcacattgtgagcacatccagtgacccagtgagtacccttccatgggctcatcctaaagagataatcagcctagtgtccaaaggtgtgtgtgtgtgagaacaccaattaacaaggagtatagttgtgcaccatcacccccagctaatttttttacttttttgagacagagtctcactccatcacccaggctggagtgcagtgaccaagccaaggattcgccatcagactgtacctgtcttacctgtacaaactagataaattcctctcttctctaggtctcaaaatatattgaggttcctgtgcctgtcagaaactgatatccttttttttttttttttaaattggagtcttgctctgtcacccaggctggagtgcagtggtgcaatctcagctcactgcaacctccgcctcccgggttcaagcaattctatgactcagcctccagagtagctgggattacaggttcctgccaccatgcttggctaatttttttgtatttttagtagagacagggtttcaccatcttggccaggctggtcttaaactgctgaccttgtgatccacctgcctcagcctctgaaagtgctgggattacaagcatgagccaccatatgtggccagaaactgatattcttttcttaccacaagatcaggaactttataagggaactgtgtagacaaggtaccaggccagtcattccccatgtctatcggctttataagtcaacttcagttatttaaagcagtctggtcatatcagaaaatatgtcattccagtcaaatggtggtttaaaaaagaaaacagtgtctccacttgcgtcctgtttaaaaaaaatggattcttactgagcttatgcaaataactatattgccaaaatgtaagaatacgcacaaatagtttctgaattctggagaaatcaggtagagagaaaggtaaatgtctcaatctgctcccaaaagtatattttaggctgggtgcagtggctcatgcctgtaatcccagcactttgggaagccaaggagggcagatcacttgaggtcaggagttcgagaccagcctggccaacatggtgaaaccccactgataaaaatacaaaaattagctgggcatggcggcagtcacctgtaatgccagctacttgggaggctgaggcaggagaatcacttgaacccaggaggcagaggttgcagtgagccgagatcacaccattgtactccagcctgggcaacaagagcaaaactctgtttcaaaaaaaaaaaaaaaaaacagtatattttacccaatttctgtgacttacaagtagctcaaaagaaataaagttttcttgattccgcaaaacaaaacatgaaaagaatcagcaatgtttcaaacaaatagacataaaaatcatttcactcctccatcagttcagtcccatgtaattaattcttgttctgcttgatgttgagttagtgatatggtttgaatctgtgtcccaaatcgcatgtcaagttgtaatcccagtgttggaggtggggcctggtgggaggtgattgggttgtggggacagatttcccctttggtgctattctcatgagagtgagtgagttctcatgagatccggttgtttaaaagtgtgtagcacctcctctctctctcttcctcctgctctggccatgtaagataagcctgcttcccctctgccatgattgaaggtttcttgaggcctccccagccatgcttcctgtacagcctgcagaacccttgagccaattaaacctcttttctttataaattatactttctttcaggtattctttatagcagtgcaagaatggactaacacaattagtgatcttcacgaacacaccagttttttattagtgttctgtaagtttttacttagtctaatgatatgatctacaaagcagtcagaaacctctattcaagagtataattcctggttctttccatgaatatccttgaagacataacactctaggatttgcacagagctaaaagctctatgcagaaaagcatcagattaaagcaattcactacatgtaccaagatatatcaactttttagaaacctcatacaattttgaaataatattcgtaacatatttatggtgttgggctctttgcaggctttcacaggctgagcctctgtgcagtcataatgctgcatggaagccacatcatcacttgcatggcccctccagccagccgggcacctgagatgagaactgcacccaacccagcaccacagctcagcccccagcagcagccccaccctctgcaactggcttttgtgctgctgcaccttggtagctagctctgatggcccaaatggcaaccactgcagctggcattgctacaggctctactgtggggcacacactgggggctttagtggaagaaataatgctgagcctccaaggcctggcctcacttaccaagaacctcagggaacccggccagcacagcagcagcagccttgcttctgagatgaaacagtttttggagcgtggccagaaccaggatgacataaagctctgtgaggtctcaatgaggtgctgaaacagtgcagatttgcaaatggaatagcctaatcaagaagtccaaactgaagaaatgaaaatggctctcatgaccaagttaatttagcataaaatataattgacagtaaaggtataaagtataaaaccatcagttaaaattctcctctgtcattcatatctttcctgcttcagaattacaatggaagagggtgttctcaatgtgtagaatttcaccgagatggtatagaattttgggctggacaaatatttctgtggtttccttaaacgagctgttgtaattttattgtttgagcgttaattagaataaagtgattttctcaccacccccccacccaaaacaaaattaatataggcatgctggctcacatctgcaatcctagcactttgggagttcaaagctgagg

SEQ ID NO: 10788 - DNA, 20773 bp, Homo sapiens
tgaatgaatgcattatgaaaggaattcttttacatgcgagtttgctgatagtcttagctaattctcatgtgtgtaggtgtcttgcctatctgtcagtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgggacaaaagaagaaagagtgtatgctgacatctaggagggaagcacccacctcccctaagctccatctccctgagcactcatttcccaatgaccataccaggttttggccctagagagtttattacaaaataagaaagagaagtctggggaaggttcactcatcatagaattttggcagttcattgcccaagatgactcgatggtccacaccggcagctgtaatagtgaccaggtagatgacacccccgcttgagccatcccggctcatggccagagcaatagctgcagagggtttcaagttggagagagggagagagaggatggcttagcttcaaaaatctttttactccccctccatccatatgcctactaccactttcacctcaaaactcatcttccaggaaggcatatttagtggtgtgctggtaaatcagtttttttacaaaaaggcttccatatgtggcatctgctgatgtccgtggtgtaaatgctcccgctatgatgaattgcaagttacaaatagctaagcagttcacaaatccttgactatttaacagtccgctctcatgagtggtcccaagccagcctcagcacacctcagcacaccactggttctttttttttttttttttctccagacagggtctctctctgtcacctaggctgcagcgcagtggtgcaatcaccgctcactacagccttgatctccccggctcagatgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctcccaaattgttggcattacaggtgtgagccactgtgcttagcacaccactggttctcacagtgactgtgtatcctcatttgatttactcagaacagccctggtttatccgtattgcccaagaaccccattgagctttgcatttgtcctgccccttttcactcttaaaagtgtaccaggcccggcattaacttaaatggccacccctgtatttctcttcctgttcctcataatctacttccttcccatgtttcaaagccctccccaggtacccttccacttggctggttaccgtctgtggtgaagcgcctgcactcctcgggagacatgcctggcttatatgctgcatccacataaccatagataaaggtgctgccggagccaccaatggcaaaaggctgtcgagtcagcattcctcccagggttccatatacctgggaaagggatcctcaggttaaagaatcatcaagcccttccttcccactgagacattaagtggtctctgcaccctgcaatgaagccctggtatctcatatccccaaagtactatgctttcagaggtagtgtccttggaactcattgctagaatgacataggacttccatcttcctctgcaggagagtggggaagcccagaggagagagtgctttgggagaaactcacctgacctccttcacgttggtcccagccagctaccatgagatgtgcagacaagtcctctcgatatttatagctgatatttctcaccacatttgcagcagccaaaacaagtggaggttcctccagttctatcctgagggaaatattaggaataaaggttgatagaattttaagtctcattctcctatactgttaccatcatccctgctaaacgacccctgaaaactgtaactgcaatagctcaaactgcagcctccctcccacatgtacaggggaaccagagtcccacaccaccaactggtaagaagctttcaattgctcactcttttgctcagccccacccacataactttcttttggctgcaaggaccctgctcttatggggaaaagcagataaggttacttccgtcccaacgaccttgatttctcgtatggtaactgcctgatattatggtgggtcacaatatcaccttcttcctgattatttatatcaggatagtgatttacagcttttaaactgtgttcacatatagaatgtggttctcaaaataaccgtctcatgaggtactatattatctccactttacagatgcagaaactgacagattcaagtgccagcaagagccgaaacaagacttttccatttcccagtgtccagctcctggaacagcacactgtacagggattcatgcaggttgggggagctctagtgggtggggagtcagaactccagagcttcatacccatggagctccagctggtaggcggccatgtcggccacggcttgggcatcagcagctgaaccagagagtgcacagtagatgcgctcgtgcagcggggacagcttgtcaaacactcggttcaccaccgcctcgctgtcaggagggagtcaacagtcaccaagttaaaactcaggtttttttttttttttttttttttgagacagtctcactctgtcacccaggctggagtgcagtggatcaatcttgggctcactgcaaacttcgcctccctggttcaagtgattctcctgcctcagcctcccgaatagctgggattacaggcacccaccaccaagcccagctaatgtttgtattttcagtagagacaaggtcccaacatgttggccaggctggtctcaaactcctgacctcaaatatctgcccacctcggcatcccaaagtgctgagattatagatgtgagccactgcacccaaccagaactcaggaatttttgagggtgatcattcaatgtctctcaaatttctttgacaagagaatagcatgaagtttaatgcttggattaaagcaggaggcaaataatcatctcagatattattaatcactgcagatgttaatcaaaattaggcttatttttcaggcttagattttataacaaagcaaaaaatgctaaggtaagaaaaatatgcctcatcaattttctttgctattaacaatcttgagagagttatgttctatggaacataatgtcagtaatattgacctaaccccatatactcattttgcatgtgaggaaattggttaggagtgggagaagagacaaaatagttcaatatatggtaaatgagaaaccaggtatctgcttgacagaatcatctttttgatccctaagcacagatggaaagaagaccctcaaaaatctatctcctgtccccctctcagaccctattcctttactcatccctgtacactactgggacaggtcacatacacattcagaccccagatcctcctccacaaattcagagacccaagcacccaccaaatagcttatcatagtggcttttggggaaggtcaactccattcctccaaggctccagtttgccagtcttttcatgaatgggtaaggaaagtgtgtatttgaggccattagcttctttccaaatgcatacatcttcacttttactcaccctgcagacactcgggaatcagaacccatcacaacgcccccgtcaaactccactgccatgatggtggtctgcagagacacagaatatggaatgtcagggcaagaacagccttgatgccctcatgttagagaagaagaaacattcccagagaggcgaagtgactggctcaaagattacacagtaacaggccagagctgactgtcagtacaggctttttttcccttcatctttccactttctctattgcttcatccggctgcaggggaatgccacagcccagctgtgatacaacacagaaagaactgtgtccctaagttccaacttgcctagtggaatcctctccactgtagagaggtggagatgaggctcctacaggtagaagtgaagcagctccgcaagtgaaaattatctccaacggaagggctcatagtatgtgcagatgtggtgtagacccaacacagagtaattgactatgatcttgggaaacaaggtcagtctatttttttttttttggtccacaatcctccactctcaccccccatttcatcagaagtgagctcttccaatttactgaacattggaaaaaatcgaggagggcagtggttagcatggccaggggcaaggcaggagagaagcagcaaggaacacatacagatggttgaaaataaaagtttcagttatggaatttccgatcaagaggtaaatacatatctcagcagccagggaggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcatttggcagtgaggggagatttcccaaattataagtggtttcactgtgtctttcttaccaggccgtaagttactctggccccaaaggacgctcctctgagtatgctttccgacggaccgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcctaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccgctttttccaccagcctcgcgtgcctgttcccttcacggacactctagacgacccccctcagaaaagaaatactctatgctcattgcgggttgcaagcgctggctgctacaggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccccggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgcggcgctaacgtgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagctkctcgccagcgcaggatcagcctgttcctgggactttccgagagccccgccctcgttccctcccccagccgccagtaggggaggactcggcggtacccggagcttcaggccccaccggggcgcggagagtcccagrcccggccgggaccrggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggasttgccttgttccgagagctgatctcatggggagcccccgggtccgcggatagcaccaggctactgcactggggaagtcaccctaccgccttcgtygtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctstcctctcttggtaaggggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgaccgggtcttgattctttgggccacgccggaagcggggaaatcctttgctctggggccgaagggcggggcatcctcatctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggattctacaagatggctcagccgataccttcactcgaaacttaactctcatgtccattctcaccatagccaggtctgggggctgaaaatggggcaccctgcaaatgagggagttggaagttggggctgctgtccgaaatgcacttatatggggatacctgggaccttcagtctgttccctgaacacaccctgaycccctttttttccgggttctttatagtgcagtgctggagttcktgggtgacrggatctataacaacaccatgggycacgtgcacagccacttgcagggagaggtgtttggggctgtcctgcgccaggagacggagtttttccaacagaaccagacaggtttctcctgaaactctttcrttatacgccaygtactgttcatatcctcatacatctgctttgatctcccccctccccgctctctctctctcacacacacatacacacattgttccttctcattcttgatataccctctccctgtctctctctctctgtctctgtctctctctctctctctcwyacacacacacacacacaattgtttttctcattcttgatatacctcaggagcaaaatattgtcctccttaccttaagaaaaacctagagttttcatctagcattttcttataaatctattcctatgtatccttagatagaaaccatagaatttcaaacctggaaattttgagctcatagagaccaactgcctcatctgacagagaaggaaactgaggccaagaccctaaatgctgaaactgcacagttacatatggctagagacacacttggggttagaaccctggtctcttgagtgctccacagacttcggcatgctttctagcagcactagaagctgtacagttacatatggctagagatagacctggggttagaaccctagtcccagtgagtgctccacagactttggcatgcttcctagcagcaccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtytcgggtaacagaggacacgtccaccctgagtgattctctgagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctygtatttctttagcatccaagggscatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattccyrtgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcmgggmgccataaattcttgcacctgggmctgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcctgtctgcctattgagcctgccgatgtcacttrggagacagggacttgatatttccttyaggttaatgactryggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatktccttccattctttacccttcttgcttcacataatgmtggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgcygcttcttctatctctactccttgggraggcatcacccagaaatctgtgcatgtgggagggtaggagtttctrtatttccctgtttttsttctggggtaagacatcatgctrtgtaacaaggcartgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcartaaagattttgagtcttcratctctagataaccatactcccatgtgycttgttctrtgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcytgtacatgcgtgcayacatgtggctataccgttctcatcttggccctttgctctgcagaggtagrcgaggctgggagccagctgtcagggggtcagcracaggcagtggcgttggcccgagcattgatccggaaaccrtgtgtacttatcctggatgatgccaccagtgccctggatgcaaacagccagttacaggtgaggcagtcatcttcttaatggmtrtatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatckaatataaaaatkccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcytcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggatgtctcctcttttatcatcctcaatgttttaccccctaactgcatcaccttttcccttaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcagaacagtaggcgggattgcctagtaaatatctcccattcagggaggcccaggtcgtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcaggtcggggcagtagggaagcccctagggatgcagggaggcgggcgctgaggagtggagggtcgcctgagaggaggaggcgagagcgggagcgcggggtacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagcgaggcctctcatcttcctttcttagcctagtggttaatccctggatctctcagatcattgctccttactcttgtcctatgtggtccatcttagtgctaatagtatatttcacaaaacagctttttggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatcctacaaaataattcctttccaatgcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgttcccccaccatgttccctatggatgacagatctgtttcccatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtctcatatttgaacccccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctggccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctg

SEQ ID NO: 10789 - DNA, 28786 bp, Homo sapiens
  misc_feature (1)...(28786): n = A,T,C or G, or insertion/deletion polymorphism (see Tables 1-2)
tatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatctgtggtccagggcagggccactccaggtaagagccgarctgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgcttgtctttggggaaaatgggaccaagaggtccwggataaccttggacagacaaggtttgcasagagagaagttggcaagtgcaggctcctgggcgtgttcayrtctgcatccagcctggaggggactcaggcagagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatayccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactggtgacactgaacagtgtcaggaggargtgacggatgcrgcryccccatcccataggcagagctgtcatgtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggcyctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcgrtactaggaaaactcctattttaaaatcyagccctgrgtgggwagatttgggaagaatcsttaatattragagagagagggagaaagaggattagatgagagtggcgcctccgctcatgtccgccccctccccgcagagaattacstktwccagkkacggcaggaatgctacgcgtttaatgggacacagcgcttcctggagagatacatctacaaccggsaggagywcgygcgcttcgacagcgacgtgggrgagttccgggcggtgacggagctggggcggcctgmtgmggastactggaacagccagaaggacmtcctggaggagrrgcgggcagtgccggacaggrtrtgcagacacaactacgagctggdcgrgscsrtgaccctgcagcgccgaggtgagtgagggctttgggccggsggtcccagggcagccccgygggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggacyggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctarggtgaaygtttccccctccaagaaggrgcccytgcagcaccacaacctgcttgtctrccacgtgacrgatttctacccagrcagcattcaagtccgatgsttcctgaatggacaggaggaaacagctggggtcgtgtccaccaacctgatccgtaatggagactggaccttccagatcctggwgatgctggaaatgaccccccagcagggagaygtctacayctgccaagtggagcacaccagcmtggayagtcctgtcaccgtggagtggagtgagtctctgatgaccvtctagaccccacctctgaagagcaggggactctctggctctggggtccactcatcttatcttctgcatctataccctggggccatgtccaaaccccatctttcttctataccagctcctgagcatagtttgaagccagggmaatggagacttcctgaccttggcttrggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaaagcctgcagggtgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacgctgcctcagatggttatcaaggggtaccctaagaagaaatcatctcaccctctctttgtccccatttgtcaagtagcagtgaggccgagccaggggatggtgaaagtggaaggaggtgggagttgggcattgggtgtgaagatgctctttaaaggggttttaataaccacttgctaccaggccagtgaacacttaccatagttgatgccttttgagcatgttgcattgtaaactgtccctgaaattcctgtgcacttggcttatgggatgaaacatcctcctagttctcttgtctctcagcttctctgaagtctcattgagcaccttctcttcaatttcttttacacagtaagaataggatcagctgtgctaaactaacaaatacccagatatccaggtttggctcatgctacacgtccaaagtaagtcatccaggaagctctgcttatcatcgtactcaggaagccaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaaatagagaagtaaaggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaacggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggcgtcctcccacatttccaggagcagatcatgcctcttacacgtgtgattctagaacatagaatggaacagaatttttgagatcattttatgaggttggttcatttatatttccagagccagctaagaatagtacaggagaacaggattgtggactaattttagccatgtcactgaatccaacagtacattataaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactcaatgaatgtcatttctcattacatttgttaatnnnnnnnnnnnnnnnnnnnnccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccakaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtywgacagaaaagaaatgtcagaaagctctagaggccactgawatcagatartcggggaacaaacatgacctatrgcgagagdgggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggt

SEQ ID NO: 10790 - DNA, 16412 bp, Homo sapiens
gggaaatgggagtgttgggggctatggaggagatgcttggatagcttagggcagcagtctttttttttttttttttttttttgagatggagttttgctcttgttacctaggctggagtgcaatggcacaatcttggctcactgcaacctctgcctccagggttcaagggattctcctgcctcagcctcctgagtagctgggattacaggcatgcgccaccgccccctgctaattttgtatttttagtagagacaaggtttctccatgttagtcaggcaggtctccaactccgacctcaggtatctgcctgccttggcctcccaaagcgctgggattacaggtgtgagccactgcgcccggccagggcagcagtcttaaattctgcacctatactcagggaaataattttgaagaagtatatactccttcatatatctttaagtaggtatctaaaaattttcatcataaattaaaattgtggccgggcacagtggctcatgcctgtaatcccagaaatttgggaggccaaggcagggggatcacctaaagtcaggagttcaagaccagtctggcaaatatggtgaaaccccatgtctactaaaaatacaaaaattagccgggaaagttggtgggcacctgattctctgcctcagctactcagaggctgaggcaggagaattgcttgaacccgggaggcagttgcagtgagccgagatcgcaccattgcactccggcctgggtgacagagcgagactccttccaaaaataaataaataaataaataaaaataaaaataaataaataaaaattgtttcaaggatgtaattctggcatattgaaaatattcacattttatttattttttaatttttattttttttttgagatggagtcttgctctgtcgcccaggctgcagtgcagtggtgcaatctcggctcactgcaacctctgcctctggggttcaagcaattctcctgccacagcctcctgagtagctgggaccacaggtgtgcaccagcacccctaatttttatatttttagtagagatggggatttcaccatgttggccacgctggtcttgaactctttttttttttttttttttgtgacagagtctcctgttgcccaggctggagtgcagtggcagtgatctctgctcactgcagcctgcctccacttcccagattctagcgattctcctgcctcaggcccccaaatagctgggactacaggtgtgtgccaccgtgcccagctaatttttgtatttttagtagagacaaggtttcatcatgttggcaaggctggtctggaactcctgacctcaagtgatccgcccacctcagcctcccaaagtgctgggattacaggcatgagccactgcgcccagcctatttattgatttattgagatgaggtctcactatgttgcctaggctggtctgtaatcctgagatcaagcaatccacccacctcaacttcccaaagtgctaggattataggcggtgagccacagctggccacattttattttatttatttattttttgagacagagtcttgctctgtcacccaggctggagtgcagtggcaccatcttggctcactgaaatctccgcctcctgggttcaagcgattcttctgcctcagcttcccaagtagctgggactaaaggcgcgagccaccacgcccagctaatttttgtatttttagtagagacgggggtgtcaccatattggccaggctggtctcgaactcctagacttcgtgatctgcctgcctcggcctcccaaagtgctggaattacagcatgagccactgcacctggcctatttatttatttttttgagacacagtctctctgtgttgcccatgctggagtgtagtggtgcgatcttggcttccggcaacctctgcctcccgggttcaagcgattctcctgcctcagcctcccaaatagctgggactacaggcgcccgccactacacccagctaatttttttgtaattttagtagagacggggtttcatcatgttgggcaggctggtctcgaactcctgacctcaggtgatctgcctgcctcggcctcccaaagtgctgggattacaggtttgagccaccacgcccggcctatttttttattttttgagacagagtcttgctctatcgcccaggctggagtgcagtggcgtgatcttggctcactgcaacttttgcctcccaaattcaagggattcccctgcctcagctcccaaatagctgggattacaggcgcccacgaccacgcctggctattttttgtatctctagtagagacgaggtttcctcatgttggtcaggctggtctcgaactcctgacctcaagtgatctgcccgcctcggcctcccaaagtggtaggattacaggcatgagtcaccatgcctggccccacattttaaaataaaacaattagatcaccatttattgtccagtggaattgaaatatcatagtgatggccgggcacggtgcttcacgcctgtaatcccagcactttgggaggctgagttgggtggatcacgaggtcaggagtttgagaccagcctggccaacatgccaaaaacccatatccactaaaaaaaaaaaatacaaaaaatacaaaaaattagctgggcatggtgttgtgtgcctgtaatcccagctgctcaggaggttgaggcaggagaatcgcttaaacccgggagtgggaggttgcagtaagcagagattgtgccattgaactccagcctgggcgacagagcaagactccatctcaaaaaaaaaaaaaaagtataaattagttcttaccagttgggaatcattccttttttctttcatcacctcttttttccttgagctcctactactactccacttccccacaaactttatgcttttatacttgaaagtcctttattgaccaatcttttacatcttcctgcatatacatgtatattaattgagatgaaaaatatctttcttgtgattgtaagactctagttgttaaaaattattctggaggagttactgttacaattattataagaacagaatgttcttataaacatgtgatcgtacacttttttttttttttttaagacggagtctcgctctgtcgcccaggctggagggcagtggcgcgatctcggctcactgcaagctccgcctcccgggttcacgccattctcctgcctcagcctccggagtagctgggtctacaaggcgcccaccaccacgcccagctaattttttttttttttttttttggtatttttagtagagacagggtttcaccgtgttagccagggtggtctcgatttcctgccctcgtgatcctcctgcctcggcctcccaaagtgctgggattacaggcgtgagccaccgtgcctggccgatcgtaaacatttttataactgttaaaaagaaatatttaataagatagtagtctgggagtggcggttcacgcccataatcccagcactttgagacgctgaggtgggaagattgcttgaggcaaggagctcaagatccatctgggcaacacagtaagaccctgtcgctataaaaaaccttttttttttttttttttgagacagagtcttgctctgtcgccaggctggagtgcagtggctgatctcagctcactgcgacctccgcctcccgggttcaagcgattctcctgcctcagcctcccgagtagctgggactacaggcgcgtgccaccaagcccagataatttttgtgtttttagtagagacggggtttcaccatgttggccaggctggtctcaaacttccgacctcaggtgatccgcccgcctcggcctcccaaagttctgggattacaggcatgagccaccgcgcccagcctccacaaaaaactttttttaaaaaaattagccaggtgaggtggtgtgcgcctgtagtcctagctacttgaggtgggaggatggcttgagcccaggaatttgaggttacagtgagctatgaccgtaccaccgcattccagcctgggtgatagaacaagaccctttttttttccctttttttttttttttttttttttttttttgagataatctcgctctgtcgcccaggctggagtgcaatgacgcgatctcggcttactgcaacctccgcctcccggattcgagcggttctcctgcctcagcctcctgagtagctggagctacaggcgcctgccaccacgcccagctaatttttttgtatttttagtagagacggggtttcaccatgttggccaggatggtctcgatctcttgaccccatgatacgcccacctcggacccccaaagtgctgggattacaggcgtgaaccatcgcgcccggccgaccctgcatttaaaaaaaaaaaagacaaaagaaaggaaaaaaaaaaaaaaaaaaagaaaaggtggtattcatggtgccttggtgaaagaaacagggtacatttccctttattttaaacaggtaagattacccccaggagatttcatggttgagaactatacttttgaggggggaggggaaaaaagagaactattcttttttttttttttcttaagagggtgactctattgtaaaaggagaagtgaagaatgagaacctgtactgcaggtgtttccttaggaagaccaattttgggaaagttgaggttcttgaaattaaatcccttacatcttccaagtcccagtcctcgcggagagtttttatgttccccattttgaaagctgtagactttgacgactggagagaagtgatgtgggattgttcaacggacgggtgtttgcgattctaggactcagcgttagggatctaataagctctgtgaccctagttaagtggcaagatgcccaccacttgtggaaatgggaatcttagcgattgggaccctgttaatctttctggtttcctcataagctcacctctggacccagccttgcctccacgagtccctccagcctccctaaacacaacgaggtgggtatcaaatctgtttcttcatccttcattcttttttcccctctccccgaagaggaggaggaggagacccaaagtattttatgagcctcatttcgcctcacagcagccctcgcagcggcaatttgcacaaactctcctccaagccccaccccatcatcgcccatccgcagaccctaggcctcccacgacaaagcacggccacctggtcagcacagacggcccttcgaggaccccctctggagaagaaccattcaggtcccaacggtctggctggtcattagttctgtggtgaagcttgaaaagcaaatcagcaacaatagtaataacaataacacttttatggcgcgttgtgctcatttgtacgcatgtgttataacgatcgcgggacgcagcacctggcagtagaaacagctgctggacagcggcaaggagcgcgccgcccttgcaggggaaggggctgggtcagccgaataagccgtggaaatgggaacctgggggacaggaaagcagggccagatagcttgccaatagcccaactgaaagaaaaggttttacttcccttttaagagacttctgcccttccctgaaactctgcacagctttggaaagcccaattcctaatccaccctgttcggttcccctgcccctccttggaaacgaggctcggtcctccctacgcgctactctccggcggttgggccccaggcaggaagtttctgattggcggagtcgtagaagcaccgggtgaaaagagctccactggctgcgcaccggagtccgggcgtagccagtgccgtacggcaaaatggcggcccccagctgctttgggacgcctgggttcggggagacaaactccgacctggaagagaccgctgactatgtgggccgcactggaggtgttcgcggggcgggcctactgtcacctccggccacaggaagcctgtgttccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggtgggggccggacggtgcggggatcagaggcgggggcggggatatagagggagaggtattggggagagctgggcgctgagtctgaggggaawgctgtggtaccttcctgtccctgaaagggagtggagcggccgggggctgaactgggggagggggatttggcgggaagcgcatctagcggaccggccggacccacggttgggatctaagaggaatcgcgagagcgtagcgcggtgyggggggacttttgatcagttacgggtcaccgagagaatggggaaaattagggtggggtgaaagggaggggacttggktaaaatatcttcaacctaaagccccagtttgaggagactcatcggagggtgaamtatggagataattcaaggaggagaaaagagaacggactgttgggagggaacctctttcacctcagagagtctaggagttggggtgatcattcaggatagggtgggtgtggggttgacttgtttgagagcagagggggcaaacacatgaggtggcgcccacaggagtgtgttgtctgtgcaagggggtgtcaggacgatttggggtgcagtgtgggaggaagaatcaacttgccaactctaagaaataggggggaaatgcaacagaaagrccggaaatcgacgtgaggggtggagcagaaggtggcaacttaaggtgtgggggtggtttgccccccccccacaccacttgaagggccccaaaaagcatatagarctaatggttattgaaatcaggtggtgaagacagtgttggtcagggctggatgttactgaaacccaaggagttcagaaaatgtgtgaggtgaagggatggggctatgctggaggggctcattctgaggccccatccccttccagcaggaattctgaaatccccaccayttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagaggtgagctttagcggggaagattgttgtaccccagggagggggatggctgactggttctcctgtcctttctttcccactaaccccacctcccctttctctcaaccccctcccttgtctctcttccccttccttcttcccctgaaccttctagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggtagggkgttggtgggatgcctctcagtgacccttatatgtcaggtatgaggcggatggggcatctctctagtcctttctagggtttttactcttctagtcccttcaagggctgagtgctctgactttatgtcttcccacgtaggcgttgaccctgcactatcagatcctgtgttggcccggcgccttcgggaaaaccggagtttggccatgagtcggctggatgagrtcatctccaaataygcaatgttgcaagacaaaagtgaggagggcgagagaaaaaagagaagagctcggctccaaggcacctcttcccactctgcagacacccccgaagcctccttggattctggtgaggtgtggatggggtacagccttcagagagacattgtccttcccctgcactggccaccagggagtccaggttgactgatggggkagcatgagaaggaaagcaagaaccaaaccctctggggcaagggattccttagagaaacttctttgtctcccagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtatgtcaagggaacattctcctcacctgtcatttctgttttgttaggcatgagccacctgtttgaaacctttcccttcctcctcctagtgtcctctcagcagtattttttccccctcattctcaggctaccctctccccttttcttcttttccaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaracaggatcagggccattaggaaacaggtaataacaagaggaggaggaagagggaagccaaggagggattgcaggggactttcggagagcaatactggggaactgagtctgctgggagagactggactgyccccctccagcctcagtcttcccgtacccctccacatatttatgtttctgtttctagctatgtggaaaggcaaaggtcagtgcatgagaagaatgggaraaagatatgtaccctgcccagcccaccttcccccttggcttccttggccccagttgctgattcctccacgagggtggactctcccagccatggcctggtgaccagctccctctgcatcccttctccagcycggctgtcccaaaccccccattcacakcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatkttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatcactgtctttttcttgtccttctactgttacagattggcattagctgtccccttgctcagggttagcccagtatccccggggtagtcccgctctgtcctttctagcctggcctttttttttttttttttttttttgtctcgctgtgtcgcccaggccagggtgcagtggtgagatcacagctcactgcagcctggacctcccagtctcaagcgataatgcctcagcctcccgagtagccgggactacaggcgcgtgccaccatgcctggctaatttttgtttttgttgtttgtattttttgtagagacggggtttcgccacgttgttcaggcagtacttttttttttttttaagtgcttcagccgccttaacgcactttactttttcacttcgtgcagtaggagtgagaaagccaatgaggggccgactcaaggttatttagccaatccaggcccggagaaagggggcggggcttcagtgggactgtaaggagctaggaagagggcgattagatcccaccaaccagctaatggtcacagctcagaggcggagcctggggaacgatacctggacccatcgccaatgggaaaaggcaggcttatagctttaaaggggaataaatgcttcggccgaaccaagtcctgagctcccagcggaggaggggacctgatcttttaaggtggaatgtggcgatgtttctttaaaggcaaagtggccgagtcggccgagtattgcccagcggcacgggcggggtgcccggctgtgcctttaaaggcggaggggcgggaggcggagcggaggcggagggcggagggagtcggcgcaagatggcggcgggaggggcccaggttgctgctctggccgccgagtgaggggcggggggggcccgggggcgcgcggcccggtaagcggggacgcgcgaggttggggggcgccttccgggtgggagaagaggccgaggtagcgcttggggcggagcgggggggggcggggtccgttgtgggcggaggtagacaaggggcggggtcgaaaggcccgatagtgggcggggcacggggggggtgggcctggaaaggggcggggctagagaagctggggcgaaagggggcgtggtcggcgagagagcttggggggcatagcctgaggggagatggagcaagcgttggttttcagtagcagagctgccctgccccctcccaaaaagtgggtgcaaaacaccaaaaaggtagattttggaatgtcaggctctcaggtaagtcggaaatagggtataattccgaaggaagccactccagcccctaagagcaccttatttctctaacctccaaggaaagggcacaagatttgtcagatacctgtgtttgctggcgctgccacttgctgtgtgaccttggataatctcttaatctttctgagctttagtttcctcatctgtcaaatggggttgagaggaatacctacctcactgttgtggggagttacacagataatgagcgtgaacatatttttgagttgtaacgggctgtgtcgttatgagatgttatcattattcttttctctttttcttcccagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccgataacccgtgtgtttgctggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggtgagcgaaccccgcgactcatcgcccaagaactagagggaagcggagggaggtggccccactggagccgatgccagggtgggagtggggcaggtcaccagacatacaaaccgctcctcactcgcgtccctatacgccaggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacggtgagtctctagggactcgccgcccccctacctctgtcgcctccaccgaaaccccctcctctttagatccggcagtgacctcaggcctcagcttcccctttgtaaagtgagtctcactacggggtagtctgtgcatttgaagttccccgaacgctgcccttccagcccctttcccggcggtgactctacagctgcaacttccttctctacactcagaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacaggtagctggggaggggaggtggagaagggtgggtagattctaagggtccagatcagccggtggtctcgctttatggacttgagcaagacatttcgccaatcggggttcagtttcctttttttgttaagagaggtggtttggctagaatgaatcaatctctaccgctccttctagccctcacccagttaaaaaaaaaaaacaaaaaaaaaactgcagcttggcagggggtagggggaaagcagggccgggcaggggggttactttctggtgtttcgaagggcggggctttgaagaggtggggtttcccgacaccagaccttgagagacttgtcaggtgatgcgaggtgggaggggttcagaagcaggagcgttttttctctgctcttcccagatctgtgtcttgctctgcaccctcagctttgcgggtcactctttcaaaacccagcactctatccccacctgcgcccacacccggcgctgcggcaatccgcaaagcaaaggctcttgcactctagcgcgttgaccttgcctgacagccccgtgtagggatgtgctgccgctctgtggtccgcaaacaggtgggctcgagtgggcggatggacgcggctggagattggatagctcctattgcactgaaaggtgcattgcagtttgaggccca

SEQ ID NO: 10791 - DNA, 19851 bp, Homo sapiens
gagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacagtgagttgggggacagaggtctccaggggtagagggtgggcactggattgtggggaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacaccttatacacatggcctgaagatttttttccttctctttttttttgagacagagtctctgtcgcccaggctggggtgcaatggtgcgatctcggctcactgcaacctccacctcccaggttcaagcgattctcctgccttagcctcccgagtagttgggattacaggcacccaccaccacgcctggctaatttttgtatttttagtagagacggggtttcaccatgttggtcaggctggtctcgaactcccgacctcaggtgatccgcccgctgccttggcctcccaaagcgttgggattacaggtgtgaaccgctgcacccgaccacaatatttttaataatatatgtgacccatcacatgagggcagctgtgggattttccacttgtggcatcatgttggcactaaaaaaatttcaggttttggaacatttcagattttagagttttggatcggcgatgctcaacctgtacatccaaaatattattgcaacatgtaaacaatataagaaattacaggccgggtgcgatggctcatgcctgtaatccctgcactttgggaggccgaggcgggaggatcacctgaggtcaggagttcaagaccagcttagccaacatgatgaaaccccatctctactaaaaatacaaaaaattagccagatgtgacggcacctgtaatcccagctactcgggagactggggcaggagaatcgcttgaacctgggaggcagaggttgcagtgagctgagatcacaccattgcactccagcctgggtgacaaaaggaaaacttcgtctcaacaacaaaaaaaaaagaaaaagaaattacagtcttggccaggtgcgttggttcacgcctgtaatcctagcactttgggaggctgaggagggcggatcacctgaggtcaggagttcaagaccagcctggccaacatggtgaaaccccgtctctactaaaaatacagaaaaattagccgggcatggtggtgcacacctgtaatctcagctactcaggaggctgaggcaggagaattgcttgaacctgggaggtggaggttgcagtgagccgagatcgcaccactgcactccagcctgggcaacagagtgaggctctgtctcaaaaaacaaaacaaaacaaaacaaaacaaattagctgggcatggtggcacacagctatagtcccagctacttggggagctgtggcagaaggatcgcttgaatctgggagggtgaggctgcaatgagctaaggttgtcccactgtactccagcctgggtgacaaagtgagaccctgtctcaaaaaaaaaaaaaaaaaaagaaagaaaagaaaataaattgcagcccttttctcaccttaagtattcaaacacaggtgtttattttaaatagtcagcacatctcaattcggactagccacatatcaaatgctcaatagcctaatgtgggtggtggctgtcatattggacagcggagcctgagaggacttttaggaggattaaggaagacagtgtatctccttaagaagatgcaggagatacagcactcagcacagtgtctggagggcagaaaatattagcctcatccttctcccatcatctgtgcccatgatagtttatatgtctctaaactgaccatgtacacctcaactgccttttaatatcctgaattcctcaccaccttcctctcttccagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaacggttctctcattccaacccctttccaagctcaatgaatattccaatcacctctggtcccttccagtgaccctgaaccgctcagagaacgccccgtcgacaccgttcggggcgggcgccactactggcgcatgagatgcgctcaagcagagggtactccaccagcgaggatacaccgagccgacggggatctcggtctcggcgccggaagcctctgagagccgaatctggaaccggatgtggctgcttcctgccccgccccctgccgagggggcgggaatcgagggcccttcggaaaacccggccgggatttcggtcagctacattcgtgggttgtggtagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggtcagagcctgagcaccctgcgcgtccccgtactcgtgacctcctccttccccaacagcaccaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggtgagacgcgggtggtgggaggtagggggcgtatgtatttctgaagtctccacttttctcttgtctctgggtccctacatctcctcctccttgcctcagttattctcgcgcctccctgggtgtcggcccgtttctctgctgcggggagtcctggcgtctccgtggttctctgtcagtgtgactcaggacctgcccgcaggaacctgccctgttcctgcctggaacttctggctggctgtcctgtccctgcgggtctttggccctccacctctgcctgcctgagtgtgcctacctctctgagcagtcgtgtcttggtccctgtctccctccttgtttttgtttggcggggaggggtttgtttccacagtaaccagctcctctgactctgggattggggagggaaccctcagatttcgtgacccctccttccctctctcccccttccccccgcccccccgccccgccccggtcctgggtagaggccgggaagccacggttctgggacctggaggaaagatcctagggtgggtagagagtggtcatctgttttcattagggattaatggtggtggccaggagcaggatttcgggcctcaggaggggccagaatttggatttggggccccgaggccctaaactcctaggtccagatcctaggtgagggcaggttgactggcagggctggtttttcgggatcggtcgggggaggggctggggccacgtgactctctgagtctaccgcccccaaccccctatcatcccacttccccttttccttcctgtactgggattggagctgctaccttcgggggtcccttagggctgagatagtggaggcgctacccgagggaccagggtgaaaggggtcctgaaaaagactaattctctgggctggtatagtccttggccgggaggggcggggcatgcggcagtgcctggactgaggtttcagctacccctagtcgctgcctctggcttgctgcctctcgcttccctctcctgccctttgtaccctgcttctctgtcgtgtgtgggttcagctctggggagaaggggctttgggggtctccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttacygtcacaagccgccaatatcgacctcttgatcccttggtgagatcatgactttagcttctcacctctgactcttcattcccagttttccttcctctggctgactttctggccagagtgctaggttggagttctggagtcctggactctgctgtgtgacataggccaagactcttgccctctctgaatatcagaaaaatgagtctggaacatctcctgggtctgggattgtcctcagaaatctaggtgcagagtgggagaaagggttagcgatcatctctctgtgttctccaggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggtcagagtcataagggacgcagggtagtggagtatctgcccggatttcctaaagccgcaacatcccaccaaaatagtcaaagccactgagggtttgggaaaaatggacagatagatcctcttctccccctcaggctggaagcccttgaatctcatcctaccgacgaactagagaggacaacagagtgagtgacccctggttcttaatctcacagtcccctctgcccaggctgcagctttacctctcacccttggctgattcccttctcccagggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggtgagagagaagattgccctacggtttgtggccatggaatggagaggcctcccatagccttagctctcttctttgacccccacaggagtgccggctgctccgaaacttctcttcagtttatgccgtggtgtcagccctgcagtccagccccatccacaggcttcgggcagcctggggggaagcaaccaggtgcggaggctgaggcattggactggggtgggggttcctcagaaggcggggaagagggggtgacagagccaggcctgtcctcagggccacttttctcccttccccagggacagcctcagagtcttttccagcctctgccagattttctccgaggaggataattattcccagagtcgggagctgctcgtgcaggtgagagcctggtttgtggcattcccacctctccttgttccctactgctcccccatgtctcttttattttgtcaccaccaggaggtgaagctgcagtctcctctggagccacactccaagaaggccccgaggtctggctcccggggtggggtgagtgactagcggggtggtgggcgtgggggtggtgattatgaaggggtgaggagtatgttttgggggagcagcctgaaggatgggtaagggaggcacagaggggtgaggagaatgaaatctgttctctgaggcaatgaggagggcaagtgcggagggatggagggccctcacgtcaatggcaggcacttctgaccctgacccctgacttcagggtgtggtcccataccttggcaccttcctgaaggaccttgtgatgctggatgcagcctccaaggatgagttggaggtcagtggtgtgtgtgtgtgtcattgcaatgatgtaacaagtgggctgcagggtcggacagacccccccgccccttgcaaggggctgtaaggcacaaatagctgagtgtgggacagagccagatctgtttctgtgccaagtcgcctcagtgatctgtaaatgggaaactagaaatagcatctacattgatctgttataagggttaaatgaatttgtatttgtcaagtgcttagaacgtgcctgaaacgtaagcacatctaggttttgtgatgggctcctgctctattgctagagtttgttaaataaacaaatactgagaccttggacaagttccttatcctctctggataaggaatcctgtcgaattggatactatccagtcctctcrtctgcaaagcagaytcgttgtctacctgagaaattcaatttaaagggtcaagtggagtgcttaggccatgatagattgaggaggaaggcagggagggatcgaagagtcagagaggctggagggaagtggttgtgagttggatgtggctgtgtgtgtttaagagaggggatattctctctctgtggccggaaggtagggttggaacyttcaccccatccccattttcctcgcagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgycgtggctataacctccaacctgaccatgatatccagaggtggctacaggggctccggccactkacagaggctcagaggtgactggcgggtgaggttgggactccagggttctggccaggtgtgggggattggtgtcatgtcctgagctctgcctattgcccccctaacccagccatcgtgtatcctgtgaggtggagccaccyggttccagtgacccwcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccaggtgagctctgctcctgactctgaccttgacgctgaccctcactctgtaaatgtttcttccttaaacctccctgccttcatgccagtcccatgttgtttgttcctagcacatgaagtggccatctgtctcgtcactagactctgccttggaaagcagtccatccctgcacagtccagctgaccycagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgagggagccttgggatggagttggggtgaaggatggtgtcttgttggactataaatgttgtctgaggtttgggcagccaaatggaattgaatgtagttttaattttgacctttggttttggcagttatgttttatttttaattttatcttctaaactctagtcttcaatagaagctgaaatttgttttattttgatggctattttgcattagttgctacaccttaaacttttggtcgccgtgttaaaatttcagaatcaacagcagtttccccacagggaagcagctctgtttcactgggcaccatgtgggctggcttatggggtataggaagccaccatattgggttttcctgttcattttaaagccttggacacaagtaacattttgtggttgggttcagtggctgagggtagaaggatgggaaatcatggctgaytgattgctcttttggtctcctgttctgccaggtgacaagccaggacaaggctccaagtgtcatcagtcgtgtccttaagaaaaacaatcgtgactctgcagtggcttcagagtatgagctggtacagctgctaccagrggagcgaggtcagaggccatgagggaaaggcagactcgggaggagagtggagtacttccacatctgggcggctgtggggggaacaactgtgtgtgtgctttacatccatcccctgaaccttcagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgyaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagcaatatggtatgttgcaaatgcccttccaaaagaatcatgccaaccaagatgagggagagttaagggttgtatatacaggcaagaagtaggtttgaagacatttaggatttcactttcaagaaagaacactgtgccacaaagagattccaagtgcaagagtttgaacctgagggggtaatacaggtggtgtgtgttaaggtggaaggggctgtggggatatgacagaagtgcctggtcaggaaacagagccaggtgtttttacattttattagctacagtatagatcctagagctgcctcattccctcccctcccctcccctccccccaccatggggtcaggccttgccaggagcccctgcctttgctgcctgggcccgctggaactcctgctgcagctgagcaagggtctccctctgttgctctgactgccgctcaagatcccgaagctgggattcgtatcgcttactaaggagagacaagggagacaagcagaaagggagaaattagtaggactcactatggagagtgctaaacgcaagaaagagataggtggaaaacttgagatccaggggagggagaagaaggggggttaaaagggaaggaaagggttggaggaactggaggactaggggccactatggagagctgttctgcaatggttcaacacctctactccaatggttcacttgcatcacagggtgcagcacacggtggtggaataaaaactcacatttcagctgtgatatagtccagcctcttccctactgtggcccgagcctcccccagctcctgtttgactagcaccggacccagaagtttaaagaccacgttggacccatccagcagggccagttcctgatggagggatgggacatatgtgatcagaaccatggctagtacaggtccctcctcgccccacaaatcccagtccctcacctctttcacgatattattttctgttagttgtgcttcaagtttctgcctccccgacatggatttacttaagtctggggatgagaggaaaggcaatttagaaacatcaaatgtgccacctatccccacaatcctagtcaggtggatatggatctgaggaagcagaaaaggatgggggcagcgggtgagtgaacagggaagagtactgagactgaggcggggaagtctctgcacgcgagggcccagatggggcaacaaaccttatctcggtaatggctttgggttgtaagtgcattgggcgagaccataccgaccctgttcccttacccttctgtagctgttgatatttctccacttctccctgtagcttcttctggatcagctccgccatggcggggatgaaagcctactgggtgcgagacaagggcgctgggtctcactctctggaaggtacctgagctcccttttctgatctggcctgcggaaatgatagcactcttgagaggtagccctgaggggcaccgcaacctcccccccgtcccggatatcgactccaccctgtccccaggagatggtgggcgaaacgcaagaccccaagcctctcaaccgaaatcctaacctactcacgttcttccttcagtagtaataaacccggaagtaaacaaggaatgctgggaaaagactgtgccggaagtttctttctgacccttgatgggaagtgtagttctgacatgtttagggagtggagttctgctaaaaagactagactaggacatttttaggcaagatggggaaactaatccagaaaaagaaaccgcaccgctacttagcccctggctccggacctgcctttcttttttaagtcactcttgcataagctgccgctcgcgataaggtgccaaaaactgttccgcccctctaaggagagcgtgccctcactcaagatggcacctagagagcttcatacctggtacgctgctgattggatgaaggacagagggcttccgggagttttcaagccgactgtgtggcagctgagaggagttttgcacgtggatcgccgttcgggtgggcgagatggagacagcccccaagccgggcaaggatgtcccgcccaagaaagacaaacttcagaccaagagaaaggtagaggcctccctgggtgggaaacgaagtttttagctgtggggtcggggggcggggcgtgagtgcggagttcctgatgtgcctgtagaaaccgcggcgatactgggaggaagagaccgttccgaccacagccggagcctctccagggcctcctcgtaacaagaagaatcgggagctccgtcctcagagaccaaaaaatgcttacatcttaaagaagtctcggatctctaagaagcctcaggtcccgaagaaaccccgagaatggaagaacccggagtcccagcgcggcttgtccggggtgagcgtgggacctgatgggtggcgaggcaggccgcctcgttccttgagagtgagagggttggggtcaatccaaggctgtctgctaattgcgtcctcctttcccctaggcccaagatccattcccaggccccgcccccgtccctgtggaagtggtccagaagttctgtcgcattgacaaatcccgaaaggtgaggtccagccggagagttgggaagtgctggaggcagggagtgtctgggtgagttggatggaggctgggacaggtagctctcctgtgaccccacttatcctgtggttcttctgccactcctccccaccaacaatgttacagctaccacattctaaagccaaaactcgaagccgacttgaggtggctgaagctgaggaagaggaaacaagtatcaaagctgctcgttctgagctgctgcttgctgaagaacctgggtgagtgagccctaatctggacccccattccctgccttttgggactgtcttttctcgtttttatgttggtatacttgcttcatattgggaagctttactgccatcctaacccttgctttcaggtttctggaaggggaggatggggaagacacagcaaagatatgccaggctgacattgtggaggctgtggacattgcaagtgcagccaaggtgagcctgaggaggtaaaggagccaagggattgattggtggtgcaggacaatagaggaatgggggctagaagaaggcgttactgcagggcactcttttttttcactcttctctttcccagcactttgacttgaatctgcggcagtttggaccctacagactaaactactctcgaactggaaggtaaggttgaattctagtgactcttgaactaagatgtgtttccttaaccacttcagccattcccagtgtatgtttgggttgctgatgaggggagggtccttcgatttgcttgggtgtgagggtaagcacctacagcaacatgtgtctgcccgcctggagagatggggctggcgtggggcagacctcaagttgtctgagtcggtggtcccctgccttaacaccctgcctgcccctcacctccaacagacacctggcttttggagggcgccgaggtcatgtggctgcccttgattgggtaacaaagaagcttatgtgcgagatcaacgtcatggaggcggtgcgggacatccggtcagtggcctcactgtcagcggtcagttggggtgagatagtccattcctgattgaatgatagcctgtgacctcatttcccaattgaaccactcttcctctcccccaggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagctgtgagtggccatggagctcaggaactggttggaagcccttgggatgaccacctctcctttaggaccccagcagagggaatacagagggcaatcaggactgggtcattctctctgtctttctctctcagtcagaaacagggtttctaacctacctggatgtgtcagtggggaagattgtggcagctctgaatgctcgagctgggcggctcgatgttatgagtcagaacccttacaatgccgtcatccatctcggacacagcaatggtcagtacctggcttagttttgactctgaccatcctgacttgcttttcttctatatttgtacttcatgagtcccttaaagttacccttttatttcccttttttgttatctcttggtcttgagttcccatctttcccatgtttagtaacctcaggcttaggtgtgtattagcaactttggttcttcttctcttccaggtactgtgtctttatggagtccagctatgaaggagccactggcaaagattctctgtcatcgtggtggggtccgggctgtggcagtagattctacaggcacgtaagtcactggtggggtgaggtgttaggagtcataggtgggcagaaaggtgtggaaggcagtgtgctttaggagcacagagtctaaagccaggatgcccaggtttaaatcgcagtgttaccacggatgggccttgcaagtataggcatatttcataacctctgtgtgccacagtttcctgaccccgaaaatggaaatatgagtgtccatttcaagggtccacaaactttttctgtaaagagtcagatagtaaatattttatgatttgctgataagaggtaaaatcaaagggtaccatgtaggcatttaaataccaagagaaaacaaattatcacaacttttttttttgagatggagtctcgctctgacacccaggctggagtgcaatggcgcaatctcagctcactgcaacctccacctctcaggttcaagtgattctcctgccttggcctctcgagtatctgggactacaggcgcctgctacaacacctggctaatttttgtatttttagtagagacagggtttcagcatgttgttcaggctggtctcgaattcctgacctcaagtgatctgcccgcctcagcctcccaaagtgctgggattataggcgtgagccactgcgcctgacctttttttttttaaatcttttgagagagacgtagtcttgctctgtctcccaggttggagtgcagtggcgtgatctcggctcactgcaacctccgcctcccagattcaagcgattctcctgcctcagtctcccaagtagctgggattacaggcacctgccatcatgcccagctaattttgtatttttttgtagagacggggttttactgtgttggccaggctggtcttgaactcctgacctcagatgatctgcccgcctcggcctcccaaagtgttgggattacaggcgtgagccactgcgcctggcccacacatttttaggttataaaattaaacgtaatatggccaggtgcggtggctcacgcctgtaatcccagcactttggaggccaaggcgggtggatcgcctgaggtcaggagtttgagaccagcctggccaacatggcgaaactctgtctctactaaaaattcacaaaattagccgggtgtcgtggcgggggcctgtaattccggcaacttgggaggctgaggcaggagaattgcttgaacctgggaggcaggggttgcagtgagccaagactgtgccattgcactccaacctgggcaacaagagcaaaactccgtctcaaaaacaaacaaacaaacaaaacataatatgagac

SEQ ID NO: 10792 - DNA, 16526 bp, Homo sapiens
caattgtccacacttgtcctgcatcccattttctagaataatccattttcttatattttatatgagaaaatttcctgtttcttatattttatatactcagaagcatactactcttttgtgcatcactttcttttactttctcagacactctttcatctcatcagcatatcagaagtattttattctttttagtggtgaatttttgcattatcattttgctgggcttgcctcactcccctgtctctccattatctttgctgtatctcaatgctaaatgctaaatattataaaaacaatcttctctaaaagtgtctccttgactttctccctctgcctctaacaatttccttgggaatcctaaaatccagatgcctggctgtccactccttaggctgggttccttttcacttgctgtagtagttattatgggctaacttgccttgtaatgtttgactcactaggtcataagtttttatttacttatctatctgcaccagtgatggtaagccctgtgtcttgtttacttgtatagccaagcactcacaaggtacctgacacaatataggcattcagtaggtaattattaaataaatgaataaacattaattaataaataggttgatgtaggtgcattcccaaggtgtttactgcaaactacaccatctaactataagatcccctataggggattccctgtaggggatgggaattgcacctcttctctttcttccttctagcttgtgactcatcttttactggaaggataccttcttttaatatctcctacctgatttcccatatgcaaatcaacactctcagctttcatgtgttcacaccatgagtaccatctgccagactctatctctttattagagtatttctcctctatatgtgctttaactgatgagagtgctctagaaacaagagcccctcccccatcattccttcatatgcacttgaaaagaatatgactgtgtaaaagtgtatattgtgtaaatttttgtgtaatgtttatatatgtcaattaggccaaatattaataacatgctcaggtctagacacttactgacttttttctttgttctgttactgtgagaggtattagaagtctcctactatgattgtagactggtcttttctccttttagttctggcaatttttgctttccatattttgtagctatgttcatgagtacatagagattaagagtttttatatctccctgttagattgacacttattgttataaaatgtctttatctctaggaatgcttcttgttttaaaatctactttgtctgatatcaatatagctatacctactttcttttggttagtgattgcatagcatactttttccatccttttattttaatcttgctgtgtcactgtcatatttttcttaaaagtagcatttacttgaatatttttaaaaaagaaaacacatcagtaatctttgactaataaatggagtatttagcccatttatatttaatgtaactactggtatatttctggtatatttaagtaactttcccaaagccacagcatgttagtgggagagtgcacactaggcatttcctgactttcaagtccaggatgctttctcattcattacctcagacttgggttaaaggctgtatttcccaccctcacatctgcttctgccactgctgtaatatttagtccttcaagttccttcagagatataggcggcaccgctctggaatcttagcctgattccagaataaaggaatgttaatagccctctgtgagctttccaggagcccacacaataaggttggtaggctttcaaagaaatcagttccattagtgaagtagcacaaacaattgtgaatttccttgaactcacctgaaagccttaagatccaggagtaaattcagggtcaggaccttgatgccatactacaggttgagaacccaaaacatatctaaggtaggactgaatctaggacccacagccaccagcaaagaactacctatgctatattgctagcactccctagctcacctattttacttttttttttttttttttttgagaccgagtctcactctgtcacccagactggagtgcagtggcgttatctcagctcactgcaacctctgcctcctgggttcaagtgattctcatgcctcagcctcccaagtagttgggactacaggcatgagccatcacacccagctaatttttgtattttcggtagagacgggatttcaccatgttggccaggctggtcttgaactcctgacctcaggtgatccacccgcctcggcctcccaaagtgctgggattataggcatgagccactgcgcctggcctattttacttttaagaacaaggaaggctttaagcattctaaaacacaactagggaggcacaggagaaaacagtggtgatctgggaaagctggagtacaagatgaatgaaaccacttaccttcctgcaggtgctcctaacgtacacagtgcctcagtgcctctgtcttatggctatgagctttacagcaatctttctcaaactgcaaaaaggcctaactaaaatccatcttgcaattcctagcacttgcgttaaggtaggcagcatgtctacacatccttctgtaggatgtaggtttaaaaatatcagaagattttttacccaaaagatgcccttgtgccagcctgctttttcatgtgtaaaatacaacaattactgctactaaaattaatttatttggtgctcagtgaatgtttatttagaagccctattttgcataggaaatagactttaggtacaacatgggaattaacatgggtttgagtagtattgggtttttttggaggactggtattcttaaggaatttttaaacagaagataaggcacatgtgcaaatagtctataatgattattatttgtggagtgtttattatgcacctgattctttacaaatatttcatttaatgcttacaactgccatgcaaagtaggcatttgtatcccaattttacaaattaggaaactgagattaaggaactgtcccaatttctcaaaccaaatgaacaatggaaagaatttgaacctcaatggtagaaagaatttgaactccaatatgtgtggctttttccactggttccacatttcttccctaccaatggttcataaaaagaagtagtgagttttccaaatggtacaaacaaaataccagagaagtagaggtgaggaaggtagtcacttccaggtgtgatgattggggaaggggtcatgggggaaagccactgaggtgggcctttaatggagtgggaggtgggtacaggaggacaatattctatattctagacagagggaatggcctcagcaggagggtgaagatgagaccatttttgagtgtggagaacagtataacttaatatgcaagatttatattgagaggctagcagaaggcaaggcggaaagttaaattgaggcaagattgcagagtcgatgacaggcgaaggagaaagaactctatgaggcaataaggagctgttaaactctgccccccaactccagggatttggagccatatacagaaaagatctagaagaaaaagaagggagctacagtgcactgtcacagtgctgaactctgacagaagtggcggcggggaatggaattgatgattccaaggagaaggggaactctaagaccaaagagaagaggactatagatttcagtgaccaatgggttttggagagtagaagaaatgtatgaatcacaaaaactatagtggtgagagcctgggtgatcaagagaactttggaaccacacacggaaatgtgggcaacaggaagaggtgctggcttaggggaaagaaccacctggaaagtgtcagccacacagggtctgtggtcaggtatgttacaccgggggccctggggcaggctgaatccgaggaagtatcacaaaggaaaggagcttcctgagaagagaagaaccaagtgaaggccacttcaggggtagagggctgggaaagggtaggagaaataggagtagaaaaatcaacagaaggaaaagaggtaatgaatttggggtcaaaaagacagagtaggtaatgaccctctatagactttgcttaaggaggaaactttgttcttacaatgagtgaatgaatgactgcaaagaataaatgaatgcaaagttactcaatgcttccatctgacaaagagtgcgtgaaatagccaatcagttgcttcactatccaaatggagaatatagcccactatacataagccattttgaattatataagctactccataatggagcttattagtgtggttcccgggcttgagcccaatcttttcttcttgtgaaacgaaatcaagatagtattgtttccctgtcaataatgggttcttaaatgggcttgagctttgtgagcactgccaatatcaacacttactttagaggcaatcttgataaaggagaatctgataaggcacaagagagggcaaagagggtataaatggcaggttggatgagggacactaccactgaggcaacatggccaagctcacccttctcactggtaagagatcgtctcatctctgtacctctgaatgactctctccatcttgtttttctgcccctttaaaactcttttaccttcaaatttaaaccagatcaactgagatttttgctttcggcaaaagtatggggatgtactgaacagggggacagccccaaattgcctggtgataggtttctcactgccctgctgtccccctcccttcaccaagcctcaaaggctcatggtactttaatggtcttttgaatggaaatagaggggagtgggtttccaggacaaatccaaaggctttgccagcctcagtaggttggtcatctacagaggatcttaagagaatgaaaaatagaaaaagcttcctactgcttaagtgaggtgactaatgtataaaggctactctactcacattcctccagttcattattctctctgttgctttaaggtctgctccttgtgctgacagctgaaataggtaggtatatttcttgggatgaaccactatattgttcctctttttcttattcataatttggaaactcagtactgccctgtgtccttccacatcagacaaagaatattaactactctctacagagtttgaaattccctaaccaagtttaaaggattgataccattggcctaaaaatcccaaagcagaaaccaactagatggcagtcttaaagaatacgtgctaacaataaaaactaatgtggtgaggcagctacacagtgtcctctgctcttaaaacattttaaaatctgtcatcttactgagttttaaaacaactcttctttgagaggtgtacaggaaaggcattaccactccatctcacagaccagttaaccagggcagagataagacatatgacctgacctaggtaatacagagagttcatggcagaatctgaaccagtagccagggcccttgtctcttggtggaagactcatttccccctgggtggaattactcagggagatatccaaaagggctaaataggcttatactatcatcctttctgtgtctcagtttccaaatgggttaaaatgagaaaataataatacctctctcaaagggttttggtgaggattcatgagtaaatataagtaaatttctcagagcaatgcttggtacgtaagctgccacataagggagctagaatacatctaaatcatagttcactaagctttaaaattctatttcagctaaaggcactggtttctaaggttatttaattctctcttggaggaacagagctatctctaagagatatcttcagccctgaattgcctgctcattattgcctgcaaattatataattataggtttgctgcaacataaagttcttacattgacttttcccctttcctttgagacttcaaatagggaaatcatttggaaatctgtggtttttaaagaaatctgtgactcactagggagcttgtctctcaccttctttctctgggtaacaggctctgcctaccagctgacatgttacttcaccaactrggcccagaaccagccaggcctggggtgcttcaagcctgatgacatygacccctgcctctgtacccacttgatctacgcctttgctggaatgcagaacaacgagatcaccaccatcgaatgggatgacatgactctctaccaagctttcaatggcctgaaaaacaagtaaatgacggaaaacctgagtttcaaatcttttaacctttaaggacagtttaaacaagatcttccacagcagacttcaggctgaaattccaaacaggccaacaagcaggtaaattcagctttcttattatttcaagtgcaagaatgactctaattttaaggggaatggctggctcacagaagctagctgctaactaaagcccagctcagttgccaagggaagcttataagtccaactactggtggactcagttgagaacaatcttccacttagaagcaatccaaagctggcattgataaagcattcaktctccttggtcaggagattcactcctasggaaataattggaactgtggagacattggggtrcagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatgagaggctgcatgacactttcctggcttcttgctcactattgcagctaaatgttgaaatggcttccctttcttttcatttgttctggtaaaacactttgtttcttttccctcagaaatagtcaactgaaaactctcttggctattggtggctggaactttggcactgctccgtaagttctttttggtgatgacttcctaggttgattttactctaaggtgttgggaccaccaaggtctcaccctgccttctttgggtctccctcagtttcactgccatggtttccactcctgagaaccaycagactttcatcaactcagtcatcaaattcctgcrccagtatgagtttgacgggctggactttgactgggagtaccccggctctcgtgtgagccctcctcaggacaagcatctcttcactgtcctggtgcargtgagctaagttccagatcattttcactggaaagcatacacccatctcatatgaaagatcactgggaccttaaaccyagtttcctagaattttatttggggtgaaggacctgaaaatcctattccagtaaggatgctgaggaatgaatggaaggatggaagaggttaatttaattcagtgtcatgaacctcatgaaagtaaacttaaagttactattcacagactttctcctgctcctgtacaggaaatgcgtgaagcttttgagcaggaggccaagcacattaataagcccaggctgatggtcactgctgcagtagctgctggcatctccaacatccagtctggctatgasatcccccaactgtcacagtgagtgatgtgccttatcttcaaacycctggaggtatcactcaggcagactagacttgtctttggtctgtcttgctattcagggaccttgtttaggaggctatggaagtggtgccttgtgcccgcacaggtatgggaaatgaccatcagaatgaytttaaatcctctaccccacctcaggtacccggactacatccatgtcatgacctatgacctccatggctcctgggagggctacactggagagaacagccccctctacaaatacccgactgacacyggcagcaacgcctacstcaatgtggtgagtccctgtacagatgcaagrgcagaccagagatgatgatgaaaatcacatagagattcaggcacaaaaggyatcataagtttagtrkttttctcaaatgagaaattaggctgccataatcaattaaatattctcatttaytaaaaaacttgcctatttattaacaccatactgataattttacctaatatgaaagaagattaataacaagtgcattgttttttaataaaagaaaatgatatgccactgctcctatttcaataaattataaaaggctttttccaccttcccccttttgctgtttcccttttgccttacccattttctactgttctaatcccttgcctatgtatatcatatagaatttcggacattaactaatgaatcataccaggaatatcattttaaaatctctgctcttctatcatattttttttatccaaagggtatatgtaaagcctgcttgttattaaaagaatttagttgagaattagacctatcactttaacagatatatgtcagtgatgctctaaaatatgttgcaagtactttgtacagtgggcacaaccaaatcraaaaaagtttagctaataattaatcactaggccatcagctgtgggtgagaactctagctaacccactgccattgcaggattatgtcatgaactactggaaggacaacagggccccagctgagaagctcatgttggattcccagcctatggacactccttccttctgagcaacccctccaaccatggaattgatgcccctaccactggtcctggccctgctggaccctataccaggcagtctgggttctgggcctactatgaggtatacactcagaaatgttagaggaaatgtggctttctcttggtccatgtagctaataatatgagcaatatgcaacagttcttggattggagctgaaagtggatgtttgtggctatctagaagggaggcaagataaaccctcctgttgcaccactttaattgggccttcactaggtccctttgaggctagattccaaacacagagagtgtaggaaagtaggctaccattagtgagagtatatcaatctgtagacacttctgactgccagggtattccttgatttaagagtttctccccacattgaaaataaattactcaaaaggagtaaacaaacagaatcccaaataactaagaaatttgctggtaaagcaatagaccttcattttcaaggagtttttatgcaacactcctctacttccccttccccatgtccttttacctctgccaccacaaggacactgcctacctcttgacctgtaccttatattctgttagatctgtaccttcctgaagaatggagctactgaagtatgggaggcttctgaggatgttccctatgcctacaaaggaaatgagtggcttggatacgataayaccaagagtttccaaatcaaggtagactgtgttctatgggttgttgttgcctgtgagcatgttcccattatagccctggagccacagctcagccttggtgtctgtacataactgacttcctttctaattaccacaggcagattggctaaagaagaacaastttggaggtgccatggtctgggccattgacctggatgatttcacaggcactttctgcaaccaaggaaaattccctctgatcaccaccctgaaggatgctctgggcctgcagagtacaagtgakttagggagtgagaagggacactaagcctcagacttaagagaaattccaaaggttccttggaagtcatggagctgttgcacaagtaattgtctgacattgtccattcctatctggtaacaattgattaatggtgggaagaacaaacagggctyttcaccatttcttccttccttcattcatttcacaagaaatttattgaacatctattacatatacagtgctctgtaggtaccacaggtgatctaaatgcataaatatccatatctactctatggaaatttacaatctagtgagagaaattggatttacaaaaactgcaaagctagacaacaatacagaagatattatgtgatactgtgccccctaaaagaataagtaaccttcttgtgagttcatgataatgaaaaatttcaatcagtaagatgtaaggaggaaaaaatgcactgtgacttgaaggatgaggaaggagttggtaagcaaaggggtgagtggagcaggaaggatatatcagatcagaagactgaaatatgtggagacatagaaggaggagccaagaacaaaatccaggtactagctctcacacatcaggtatcactggctaaaagcaaggaggttcaggatttgttttcytttttcttctcaggttgyaaagctccagcccaacccattgctcycattgccgaggcaaacatcacatgcggtgtcagccacagtsgtagctctgrgggcygctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcattactgtacaatcgcttctgcttctttactgtaggatcttagatgtaattgatccctatttcccaatgatatacagttgctccaccagcacccaagcctgcagcatgcactgctagtcctggatgttgggtagcggaagcagggggattaaaggaaaatacatggtcccttcattctcaaaacatgtattcagatgaaggctggggagcccaagaatgtaagactcagataacaatgacccataagcaaatgtcattttaaagtgattgatttgcccttttggctgagaatgcacaattaggaggctattgcagtgattcaggggagaggtgcaggctcagaacaaagtagtagcagtagaagtggtcagaggtgattgaatttcagctgtattcttaagatttgttaagccagcaggtttctttatgggttgcatgtagaacgtgggagacaaaaaggggagccaaggataatttcaacattttggcttaagaaattgcaaatatgaaattatcatcaactgaaatggagaaagctaaaagtagagtagattatgaaggaagagcagaagttcaactttggacatgttgaatttaagattgttattgggtttctaattggagatgtggagtagatagttggacataacatttttagaggtagttggtatttatagttggacataacatttttagaggtagttggtatttaaagtcaatagattagatgagatcattaagggagacagagaaaggaaagcattcaaggactaagccctgagcatttcagcattcagagggaggctggagagaagagtaggaacaagtaatgaagaccaaaaaaggagggctaagtgaggtagaaggaaaaccaagtgtcaagtatcctgaaagccaaggaaagaaccatattaaggaggagaaagtgatcaagtttgtcaaatactacttaggtcaggtcagatgaagtctgagaattgaccattatgtttaacaacctgtagatcattgacaaacttgacagaagtggggttggtaaacatcttggtggcaaatgcctgagtgcagtaagtttcagagagaatggaaaggtaagaattgaagacagtaaggatacaaaaacctgtcttatatgtgttaaagggaagcaaaaaatgggattaagaataaaagattatggaaaacagaagctgaatttatgttttcaaacccacatttacttatttagagatatgggagataaaaatctaacattctttccatacctctcactttcttatttttattattattttcacagagtcaaaaatttttttaacttaaaaattttttttttttgagacaaggtctcattctgttccccacgctgcagtacaaaggcacgaacatggctcagtgcaccctcgacctcctggactcaagcaattctctagcctcagcctcctaaagtgctgggattacaggcatgagccaccacatccagccccaaatttttaatatcactttgttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactttttggacatagatattggctcactcttttactcaaaattttgtaaatattactgctttttattctggcattgaatattgagctagtgtttttcctatggctctttcatttactttttcaggtttggatgttttgtagttgaacagttttttcaagtagttctgtggctgccacaggccttaagttcttttatatgtgagaatatctgcctgtctccttggttcttgaaaagtatacttcaagaatattatacttggtagagtataatacgataggcttgtactttcttttcctcagaactcttcagatgtagacaaaacttcttaacattatttcaaatcatctctgccttaccttttaattccagttgaagctacagccaccaattctgcataagccttaatggtcttcatggcgttatggaatcttacctcagatctgtgttgtgtacttcttgctacccttcctagggcttctgagatacaggtttccactcaagcaggtacaatctagacacgcagaggggttactgtcacttacaaacatcagggaaacgtaatgtttccacctttcctcccctgatgttctagaagcacattttgtaagacttttaacaccgttccaaagggatagagcatttagttgtttctaccagtggctaatatgataaaagcatgattttattggccctcccttcttccctgtttcactcccctgtctcttacttattctttgcattccactcccaaattactctcacatgagctacttccaggtgaacttagccttagatagtaggcattgctccactgtgtcctggcattgaatattgttgtagggatgtttgaagacagtggataatcactaccctttctttaatccacacttttaaagttatttgatttttttcctgtgagtgcctgaagaattcatgatttattcttgaagttcaataacttaacaaggttataccttgattatgatggtttttgtcaatttctcctataaaacagttgagaggtaagatttaacttgcctgagttaacagacctgcaggcggcctcctggaaaagaaagttggcctgttgcctctggaaaccagctataatctatagcctaggtcctaatgcaatccatcctggcagagagctgaccatggtgaatgagaacttcagccaagtttacaccaagcagttgtgcataatcacggggttggattacaccagaagaaagccaagtgttctcccaacagatgaatgctaaggtagtagataagactgaaagccaaggttctgctatatcatactgctattagatcccatatcctaatctcactaaagaagagttttgttaagaagcttaaaagtcccaacatccaaagcccagagcctctttctcagagctagatatgtgctatgttagattgttgtatgctgcctgagaataaaataaacaccagaggatcactcatctgccatcgcttctgtctctgactttttacccagaagtactattccagaaagcccagtgtgcatgctgcttggctactcaccctgaatcacttgacaactggtgtagagagctggatgtcagactaggggcacctaccatggccttctagaagtgaaccaagggacttgggatttaaaaagtgtttctcagatgatcccatcgctttcaaagattggtatggcagtcatggggactagtccactaaattcctgaagatacagagtgataaaagtgatactgcgtagttaagatcatcgagcctagcattccatgattgttattattggccttggaagaattagctctaaggaggcagaccgaggggaacttgactcagcatcttgaatgaaattacaatttgaaaactttggtgaatgtgaaatgatttatatatggtcttatccaagcaggatcaaacaaattccatcctctgaccctcttcctatgactgataggatcagttcaagatggcacaggttgtcatgttattagggtgttatgagctccagttaaatgggtgcaaagggaaggaaagacaaagtatgtgacttatgaggttagttccctcataacaagtgaagaagataatctgaaataggctgattgaactaaccgaacttctgggtagactcccactatagctccgtcttagaaagtctatgtgattactgcttctatataaagggttaaacatgataaaattgatgatggtccctatctttgtctatggaaaaaaatatccagtgagttttgggggaactcatgacccaagtcataataggaatttcaggcttcataaagacatcatggttgaagcagaggtgctctgtttccagcaaagcccaacaggaagctaacttttgctttttgaaaggaggattccccaccagactgggaagcaacagcctaggctccagagtcggacactggacttaagttgttatcagatgaatttgctcagctgcgtactgttgtgttacaaaatcaaatggcattagatacgcttacctcagcccaaggagggttttgcaccttactgcatactgaatgttctgtgtatagccctaacaattctcacaatattactcacaaagccatgttgggtgtggtttttattaattgtgcttttaattctgctgtacttaacctgtatctgtaaactatatcaaatatcccttccccatgtatctgtaagggtattttcctgcaattgagtatcagattgaggccaaatgtggaggaaaagttaaacattaaatttgaactcaactgaacatggacacaaacaatggtcaccaagtcccgcaacaggttgtgtgagtcccttgaggcgttcatccagcactgttttggaaaaatctctatttcaatctagtcctatatgttagttattgaaaaaaatagacagtctcaaaaaacaagctgacctttttatgttccttgaacctagttgtgaagggcccttgttactgggcctcatgccaaacaactcattacaaaaacagctagagtcccagacggtgccaaagcttcatgaaacctctcctcgtctgtgcacgaacaggtggccaactctggagcccaggctgttgctttccagtctggtggtgaatcctccatagtctggtgagtgtaaatatatatatatcttttcccttctccctttcccattgcaatttgattgttatatcaatttgcttattatatcaagttgtttattatatcgtttgcttattacatctgcattgccatttatgtgagataaaggttgtttacccttaaaggtattgtgtgtgtgtcttttctcctcccctcacacatctctcacacagatcattttatacccaaagggatataaatcattctactataaagacacatgcacacgtatggttattgcagcactatttacaatagcaaagacatggaaccaactcaaatgcccatcaatgatagactggataaagaaaatgtggtacatatacatcacggaatactatgcagccataaacaggaatgagatcatgtctttgcagggacatggatgaagctggaagctatcatcctcagcaaactaacacagaaacagaaaactaaacactgcatgttctcactcataagatggagttggaacaatgagaacacatggacaccgggaagggaacaagaaacactggagccagctgaggggttgggggcaagggggggagagcattaggacaaatacctaatgcatgtggggattaaaacctagatgacgggttgataggtgcagcaaaccatcatggcacacgtatacctatgtaacaaacctacacattctgcacttgtatcctggaacttaaagtaaaattttttttaaaaaggggggaaaaatatatagcaaaatgcaactggaatttccaaatgaattagtattttatttaaacatctatattttaaaaataattgtaataatgagaatacatagacacagggaggggagcaacacacactggggcctgtcgggggggggtgggggtagggaaagcatcaggataaagagctaaagcatgtggggcttcatacctaggtgatgggttgataggtgcagcaagccaccatggcacatgtttacctatgtaagaaacctgcacgtcctgcacatgtatcacggaacttaaaataaaatagaattaaattaaatcttaaaaatagtaattgtaataaattta

SEQ ID NO: 10793 - DNA, 15530 bp, Homo sapiens
ggacagggaggaggcagggccatgcgatcttaggggaacctcctagtcttggacccaagagaagtttccagaactatgactgcagacccagggcaggatcaggaaacacggggaaagcagctgtgggttctggagcaactgccctcctaaggtctgtccttagcagggaccttcccctgactcatgaatgctggaatcaaggaccccaacaccataatcatcaaggtgatacatctgtccttcattgtcatgtgcttcacaacagagtaagtgctagcacacagggtcccaggctgggatggcccatgtgtggatggtgcttccagtaacgaggtggggcacacttctacctggggcttgaaactcccagtgggacaagaaaacccagaccccactcctcaccccttccctacctgagctcttcctcctacacatcacaacagccatcacagctcctaggacagctaggacagccaggacagccaggccagcaacgatgcccatgatggggatggtgggctgggaagatggctctgggaaaggaggagaaggtgaggggccctgacccccaagcctcagccctgacccggctgaagggctccagaaggacttctgctttctctgataagagatgtgaccccccattcccctccttaccccagctcagggtgaggggctctggcagcccctcgtgctgcatatggcacgtgtatctctgctcttctccagaaggcaccaccacagctgcccacttctggaaggttccatctcctgctggcctggtctccacaagctcggtgtcctgagtttggtcctcgccatcccgctgccaggtcagtgtgatctccgcagggtagaagcccagggcccagcacctcagggtggcctcatggtcagagacgggatggtgggtcacgtgtgtctttgggtgttctgacgggaagagtcagaaaattcagacactttgtatctctcttgcgacactccaacagcgcccatgtgaccatcctgagaatggacaggacacctggggtggggaagggggcacagaacccagacgccagcctggacacaggcacctgggataatctcctattcattggaaagttctagtctctgagggaggaacagcgacttctggtcctgacctgagtggaggccgaaggactcagaaaagctggaatcaaacctttaaacacattgagcgtgaggcagagaacaaggcctgagagaaaggtcagcagcctgaccacagctgctgcagtggtcaaagtggtcaaaggggacccctgatcagtattccagggactgtcttcccctccatttcctcaaggacttcatcccttaattgtcctagagagcagagggggccctcagaggaaactcaggaaaactcatcccattctccattcaagggagggcgatattccagcgctgatcccattttcctcccctcctcgtgggaggccatcccgggagatctacaggagatggggaaggctccccactgcccctggtacccgcgcgctgcagcgtctccttcccgttctccaggtatctgcggagccactccacgcacgtgccctccaggtaggctctccactgctccgcctcacgggccgcctcccacttgcgctgggtgatctgagccgccgtgtccgcggcggtccaggagcgcaggtcctcgttcagggcgatgtaatccttgccgtcgtaggcggactggtcatacccgcggaggaggcgcccgtcgggccccaggtcgcagccatacatcctctggagggtgtgagaccctggccccgcccccgtggtcagccccgtcccccgagccccgccccagccccgaccaacccgcggggattttggcctaaactgaaaatgaaaccgggtaaaggtgactggggctctctccggtcgagggtctgggcgggttccgcagcctcggggtggatctcagaccgggagactcggggcgacccgggccgtccgtgggggatggggaggggtcgtgacctgcgccccgggccggggtcactcaccgtcctcgctctggttgtagtagccgcgcaggttccgcaggctcactcggtcagcctgtgcctggcgcttgtacttctgtgtctcccggtcccaatactccggcccctcctgctccacccacggcgcccgcggctcccctctcggactcgcggcgtcgctgtcgaaccgcacgaactgcgtgtcgtccacgtagcccactgagatgaagcggggctctccgcggccgggccgggacacggcggtgtcgaaatacctcatggagtgggagcctgggggcgaggaggggctgagacccgcccgacccacctccctgcgcggctccccgggtcctgcgccctcgccgggcgggcccctcgctcctctccgcagaggccgcttccctcccaaccccgcactcacaggcccaggtctcggtcagggccaggcctcccgagagcagcaggaggagggctcggggcgccatgacccgcatctcggcctctggggagaatgtgagtccgggtgggtgactggggactttagaaccgggactgcggagacgctgattggcttctctagaacccgacacccaatgggagtgggaattggggacgcgtcatgagtattcaggaagaaggacccgacgcaggttgggagaagtgaaactcaggggagtggagaatccccaacgcggcgcctccccaatgcagacacggcccttggagcctgagaccctgagagccccgcccgggacctgggacttcgtcctgatccctcttctcctacaccaagcatctttgtcacactgtgtgcctgagtcctggacaaggatctgtctgtggaaaccagggagagaccccaaggctgcgcccagccccttccccttcacttctcctcctggaatccccgtccctgaactggactccctgcctcccaccctttgccttaccttacctcacctcaggtaatattaaactacatccagcaaaataaaggacacttacctctccccttggactcttgtacagggaaactcaccatggggaacttgatgccagacagtgagctcgccctgggaatggacgtgtagagtcaggagttttctctttaaacctggtgaagttttgtctgaaagcaccaggtagagattctcatagagaccagtttcctttttgtttattgatacagtaggtagcacaatattggtaatccctgaatgattagaattccaatctgtgaaagacctgtgtcaaaactgcattacaattaaattctcaaagctcctgttttactttcgcagactatggatctgtgactctgggttgttgcatttaaagttatcctcattctctagccagagtttccctgtgtgagtccagaacatctcctgaatacaaagaagcagggtttgttactgtctattgcaaccgggagcctgtagtcatcacctcaaagttgcgagggctccatgcagtcccaatgctcttcaccagcgctccagcactgcccgttttcgtgaactatgcacatctaagcagtgtgcatattttatttggacacttgatatttttgtaacccctttttaaaaaaaaatcataaggagcccattagttttaaggcagtcacacaaaatgtattaaataccggatgcaaagaaccccctgccaggctcttctactgctttagaattctttcctctgctccttttcctcacctcctgcttctccagcccttctgtctgcccctctcatccttcacaccctctttcccctttagtccccgccaccctgtcactcctgaattgtggcactaacactgtccctcacttcctgcccatgtctgttctccccacagtgctcagcagtcctgctaatgtgactcaggtcgtgtcatttcttcacttataatggttggattttggtctaccattttgctatacgttttcaatttgtctcatatctttttgtttctgttcctcctttgctactttcttatgtgtcaagtaaacattttttagcttatggttttaattctcctagtggcttttagctatatttctttacattaattttttattgttgtaagaattgaaacccaattccttgacttttcacagtgaaattcaggtaatattaagctgcatccagcaaaataaaggacacttcaaatggtgtagtttcatttaaactatcattatgctattattattgtatatgttacatcaatatacgttataaactcaacgatacagtgtaatactttttgttttagacaagcagtcacatatcttcaggaaattaagaaaatgggtgtgtatgtgatatgtgtatgtgcatcatttctgttgttaattgttcctttctgtatatctgggtcaccatctagtatcatttcccttcagcctgtagaacgtcctttaaaattacatgtagtacaggacccctaggaaatgaattttatgggtttgatgatctaacaatgtctttatttttgccttctttcctcccccctccccccccccttttttttttgcttattagggcgtttacgtgtaaaaaaattcaccagttttagctgcactttttggtggatattggtaattatttatagtgtaactaccacactgcccagtagagaaacaccaaatgcaaagatcctcctactaggcccctccactgctttagagtcctttcccctgctcctcgtcctctcctcctgcttccccagcccttctctctgccccttatccctcagaccttctccccttacttccccctcccagtcactcctgaattgtggcgctgtagagaacagtttcttttccctaaaaactttctttatgcccctttctatttaatccttgcctcccaccctcacccccttcccttcattcaaccactgctgtgctttctgtcactgcaatagtgacatttctagaatttcatggacatgcaatcatatgttatgtagtcttttgtttggtctctcccttagcataacgatgtttgagatgatgccattcattcatttttgttgctgagcagctgccgagtattgctggaatcccagtttattcattggtttctgtgtctccagttgatagacatgtggattcctccagttagggcttgttattaatgaagccactataaataactgcttacaagtgtggacttacatttttatttcttttggataaatacgtatttgtggaattgctgggccatgtggtaatagatgggtaactgtataagaaattgccataccactttacaaattggctgccacattttttgcattcctaccagcaatatcagacattcctattttttccatattcttgccagtgttaagacttatcatatgtctttttaactttacctgctctaggtgatgtgtgatggtttctcattgtggttttaacttgcacttcttagatgactagtattgtttgctatcttttcatgttcatctaagtgacttattacatatattttatgaactattttgcaaattcaatgattaattccagagactttttcagaattccctagtgttttctacatatacaatgaagctggtgacaaagaaagactttcatttcttcctttcttatccattgatctgttttcttttaaaattattattatttggtagagatgaggtctcacttatcaggctggtctcaaactcctgatctcaagtgatcctcccacctcagcctcccaaaatgcagggattacaggcatgagccaccatgcctggtccttgttgcactggttaggatgactgttaggtgtttaaacaagaatgatgagagctcacatgtttgtttacaaggaacttaaacaaatttacaagaaaaaaacccatccccatcaaaaagtgggcaaaggatataaacagacacttctcagaggaagacatttacgtggccaagaaacatatgaaaaaaagctcacacacgtatatgaaacgtgactgtttataatcctatccaaaaaagacctgatttcaagcaacagcaggattgcttccattcaatacttggacctgcaaacatcaaaaaagccactggagaaactgaacgactctctgaaagccttaaactaagatatgaagaagttgaaatctggaaaaaacttgaggaaaaggacaggcagggggaagcacagtggctacaacaaaaaaggcaggaaacaggaagagaggatggcagcacgttggctaaaggttctttggagattgtattggattccaaagacaaaacccaaaagagcaatggtgaaaagaatgaaaaatgtgagaccaaagagaaaggagcaatcacagcaaaggaactatacacaatgatgatggataaaaacatcagcttgattataatgsatgctcaaagaatgcagkattatcaggattcctgtattttacattctctcagtgttcctgaagaagccatcagtccaggagtcactgctagttggattgaagcacacctcccagataattctatagacacatggaagaagagggggaatgtggagtatatggtacttcttgactggtttagttctgcaaaagatttacagattggaacaacactctggcatctgaaagatgcacttttcaagtgggaaagtaaaactgtcctgtgcaatgggccttgggcctttggttttagagggaggctataaaaactggttcctttgctattcccagtatacaacaaatgctaaggtcactccacccccacaacaccagaatgaagagttgtctatctcattggattttacttatccctcattggaagaatcaattccttctaaacctgctgccgagatgccacctccacctatagaagtggatgaagacatagaattgataagtgatcaaataagtgataatgatcaaaatgagaggacaggaccactgaatatatcaattccagttgaatcagttgctgcttctaaatctgatgtttcacccatcattcagccagtgcctagcataaagaatgttccacagattgatcatactaaaaaactggcagtcaaattgcctgaagagcatataatcaaatctgaaagtacaaatcatgagcaacagtctcctcagaatgaaaaagttattcctgattgttccgccaagccagtagtttcctctccaactctcatgttaacagatgaagaaaaggctcatattcatgcagaaactgctcttctaatggagaaaaacaaacaagaaaaagaacttcaggaaagacagcaagggaaacagaaagaaactgaggagggaagaacacgagcaaaaagccaaaaagaaacaagaagctgaagaaaatgaaattacacagaagcaacaaaaagcaaaagaagaaatggagaagaaagaacgtgaacaggccaagaaagaggataaagaaatctcagcaaagaagggcaaagaaataacaagagtaaaaagacaaagtaaaagtgatcatgaaacctctggtgccgagaagtctgtagaggacagggggagaagatgttcaaccccagaagtacagaaaaagtcaacaagagatgtgtcccatacatctgcgacaggggattcaggttcaggcaagccttttaagattaaaggacaaccagaaactggaattctaaggacagaaacttttagagaggatacagatgatactgaaagaaataaaactcaacgagaaccttcgataatagcacgaagtgaagaaatggggaggatggtaccaggactgccttcaggctgggccaagtttcttgatccaatcactggaacgtttcattattatcattcaccactaacactgttcatatgtacccactggaaatggctccttcatctgcacctccttccacccctccaactcataaaggcaagccacagattcctgctaagcaggatagggaaccttccaaactgaaatgctcttactcctccccagatataacccaggctattcaagaggaagccagcagtaactccaacagttaatcaggaagacaagccaacatgctaccctaaagctgagatctcaaggctttctgcttctcagatttggaaactcaatcctgtttttggaggttctggaccagctcttactggacttcgtaacttaggaaatacttgttatatgaactcaatattgcagtgcctatgtaatgctccacatttggctgattatttcaaccgaaactgttatcaggatgatattaacaagtcaaatttgttaggggcataaaggtgaagtggcagaagaatttggtataatcatgaaagccccgtggacaggacagtatagatatatcagtccaaaagaccttaaagtcaccattgggaagatcaattaccagtttgcaggatacagtcaagattcacaagaatttcttctgttcctaatggatggtctccatgaagatctaaataaaactgataatcggaagacatataaagaagaaaataatgatcatctcaatgactttaaagctgcagaacatgcctggcagaaacacaagcggctctatgagtctattattgttgcactttttcagggtcaattcaaatctacagtacagtgcctcacccgtcacaaaaagtctaggacacttgaggccttcatgtatttgtctctactgatagcatccacaagtaaatgtacattataggattgccttagattattttctaaagaagaaaaactcatagataataacagattttactgcaatctttgcagagctcgacgggattcttaaaaaagaaatctggaagttaccacctgtgcttttagtgcatctgaaacatttttcctacaatggcaggtggaaacaaaaattacagacatctgtggacttcccgttagaaaatcttgccttgtcacagtatgttattggtccaaagaacaatttgaagaaatataatttgttttctgtttcagatcactgcggtgggctggatggaggccattacacagcctactgtaaaaatgcagcaaaacagcggtggtttaagtttgatgatcatgaagtttctgatatctctgtttcttctgtgaaatcttcagcagcttatatcctcttttatacttctttgggaccatgagtaactgatgtaggcacataaggagacataggttataaactagttatcttttaaaaggctcagcaacacaattcttgaaatgcttatcaagataatggtagcaatagctggccatttagaggaattctaggacagtgggagctgtgttactagcactatataattcctgtcagtggtgacaaataacacttaacaagtattgcagtaagcatcacttacaggtaccatttatttcaaaacaacttttttagtctgctccaaagttaaaataattaactagctaagcattattattctactggtctaaaaacctttgtaccctttttttccttttcactgttacagccttttcacatttctaaatcccatcttcatatactatgaatactctagaatgatgtgaagcagataggaatgtatgtgtacatatttattgcatacttacacatcaaatcgatatacatagtttaacatgtggtcctttcgtgaaacttagaactcagaggattgcatttttttctttgagcatattttgagtaactgcagtgctttcttagggaaatgacagggcaaagctatttttctgttggctttgggggcatttgggtgcgctaaatctttatcttaaaaaataaatggaaacttcctttaattttttaaaatgagacattaaaatcttaatgagaaaaattaaaaaagctcaatatcactgctcattagagaaatgtaaatcaaagccacaatgagataccatctcccaccagtcagaatggtaattattaaaaagtcaagaaacaatagatgctggtgaggctgtggagaaataggaacacttttacactgttgttgggaatgtaaactagttcaaccattgtggaagacagtgtggccattcctcagagacctagaaccagaaatactatttgaccccttgggtatctacccaaaggaatataaatcattctactataaagacacatgcacacgtatgtttactgcagcactatttacaatagcaaagacttggaaccaacccaaatgtccatcagtgatagatggataaagaaaatgtggtgcataccaccatggaatagtacacagccagaaaaaggaatgagttcatgtcctttgcagggacatggatgaagctggaagtcatcatcctcagcaaactaacacgggaacagaaaacaaagcacctcatgttctcattcctaagtgagagttgaacaatgacaacacatggacacagggaggggaacaacacatatcagggccttttggggagtgtggggggcaagggacgggaacttagaggatgggtcaataggtgcagcaaaccaccatggcagactatacgtatgtaacaaacctgcaggttctgcacatgtatcctggaacctaaagtaaaataaaacaaagcaaattaaaaaaagaaagcccatgtcttacatgtatgcatatgttcattgcagcactattcacaatagcaaagacatggaatcaacctaaatgtccatcaatggtagactggataaagaaaatgtggcaaatatgctctaccggcaggatttgatggcgtgatgtctcacagaaagttctccactcccagacatgggtccctcggcttcctgccttggaagcgcagcagcaggcatcgtgggaaggtgaagagcttccctaaggatgacccgtccaagccggtccacctcacagccttcctgggatacaaggctggcatgacccacatcgtgcgggaagtcgacaggccaggatccaaggtgaacaagaaggaggtggtggaggctgtgaccattgtggagaggccaccagtgggcattgtgggctgcgtggaaacccctcaaggcttccggacttgcaagactgtcttcgctgagcacatcagtgatgaatgcaagagacgtttctataagaactggcataaatctaagaagaaggcctttaccaagtactgcaagaaatggcaggatgaggatggcaagaagcagctggagaaggacttcagcagcatgaagaagtactgccaagtcatctgcgtcattgcccacacccagatgcaactgcttcctctgtgccagaagaaggcccacctgatggagatccaggtgaatggaggcactgtggctgagaagctggactgggctggcgagaggctcaagcaccaggtacctgtgaaccaagtgtttgggcaggatgagatgatcgacgtcatcagggtgaccaagggcaaaggctacaaaagggtcaccagtcgttggcacaccaagaagctgccccgcaagacccaccaaggcctgtgcaaggtggcctgtattggggcatggcatcctgctcgtgtgggcttctctgtggtacgtggtgggcagaaaggctaccatcaccgcactgagatcaacaagaagatctataggattggctagggctaccttatcaaggatggcaagctgatcaagaacaatgcctccactgactatgacctgtctgacaagagcatcaaccctttgggtggcttcgtccactatggtgaagtgaccaatgactttgtcatgctgaaaggctgtgtggtgggaaccaagaagtgggtgctcaccctccgcaagtccttgctggtgcagacaaagcagcgggctctggagaagattgaccttaagttcattgacaccccctccaagtttggccatggccgcttccagaccatggaggagaagaaagcattcatgggaccactcaagaaagaccgaattgcaaaggaagaaggagcttaatgctgggaacagatattgcaactggtgggatctcaataaaagttattttccattaaaaaaaaaaagaaaaagaaaatgtggcacatatacaccacagaatactatgcagccataaaaaagaatgagatcatgtcctttgcaggaacatggatggagttggaggccattatccttagcaaactaaggcaggaacagaaaaccaattaccacatgttctcacttataagtaggagttatatgatgagaacacatggacacgcagaagggaacaacacacactggggtccacttgagggtggagggtgggaggagggagaggatcaggaaaaatagctaatgggtactaaggcttaatacttgggtgggtactaatgggtacagaaataatctgtacaataaaaccgcatgacacaagtttacctatataacaaacctgtacatgtactccttaactaaaaataaaagttaaattaaaaaaaaaagaaacaaagaaactgcatatctggaaagagcatatggttgggttctgtgttttgttttttttttttaaccaattcacacaatctctgcccttcattggagtgttgattcatataggtttttttttcattattgataagttttaggtctaccatgttatttcctcagttttggtttctctgttcctcttgtcctgaccaacgacttcttattagaaaccatagaaacaaaagaaagtagaataacacctttaaagtgctggaagaaaaaaaggacaactaagaattctatatccagcacagatgtccttcaaggacaggcaaaataaggagatgtttcaggtaaaagaaaattaagagaatttgtcaccagcagatctgcacaataacaattggtaaagaaaattcttcaggctaaaggcaaatgataccaggtgggaaatgaggttatcagaaaagatgaagatgatcaaaaatggtaaatactgagctaagtgcaaaaggctatcttgttcccctcatttactctaatttatatacatagaactgtttaaagataagaagaagtttttttcttgtgggacttataacctatatagatatattacatataatatctgtaccataaagatggacattttatagaggataaatggttgcaagatttctctatttatgggtactagtacatttttaactgaaagtggactgtgaaatgttaagaagagttaaattctgaaggaaattgagacacaaaaaccattcaaaagattaacaaatctcatgatggttttttgaaaaaaacaaaacaaaacaaaataaaaactaaacaaaaataaaaccctagccagtcttgagtctcatcattctacgatttcagaactattgtgaatacaaaagtaatcaaagaacagtcctgcccagaaagaggagttatccctaaatatggtgtccctggaacaggtggctctccctgctggacctcttccacgtgggtgctttctgcagtgactttgttgccttgctattccactttacccagtgtcctcacccaagagacaaggggtgtctgctgctgtatccacacttggagaaagaaaccttgatagtgtcagtacattacaagctgggcatgacagctcacgcctgtaatcccagcaattcaggatgctaaggcaagaggattgcttgagatcaggaattggagaccagcttggacaacatagtgggaccctcgtctctaaaaaaaataaaaatcagtaaacggctgggcctggtggtgggcgcttgtatttccaggtattgtggaggctgaggtgggaagatcccttgagctcataaatacaaggctgcattgagctacgatcccaccactgggctccagcccaggccagagtgaggtcttgactcaaaaaaatacattgtaagcctttgctcactatgggttatttattatttattcaatgtgtattttgattttattttactggcagcacaataaaccaggacatgctgaaactagaaatcacatccactttccagtgttaaaaagcccagtctagggaggtgagaaggagacagtcctcattagcgttgaggattcagggagatcgagatgggctgggcaggaaggttcttacttggaacctggaggatgagcaatgacattcctctctccaccttaaagctcatcctgggcatctgcctcctgggagcaggagcactgcaagctccgcctcccgggttcacgccattctggctcagcctcccgagtagctgggacaacaggtgcccaccaccacgcccggctaatgttttgtattttttagtagagacggggtttcaccatgttagccaggatggtctcaatctcctgacctcgtgatctgcccacctcgacctcccaaagtcctgggattacaggcgtgagccaccgcacccggcctctccttgggatttctttactggacaccagcctgagtcaactttcctgtaaagcaaaagaagcgtgaggttgctaaaggaggaatggtgtgatctccacctttggcgagatccctgtcaccgtgttcaggcgaagggccaggccttactccccatgcagagaggaggctatggccatgaagacgcctgtggagaagtgaggacccgctccctctacactgatggccaagagcctacagatggcggagaaggcttcccttcagctgtgtcctatcaggttcttccaggagtcaaggagtagacctgcatgttacctctggtgatgtaagctgcatgcacacctagaagtgaggtcacccctgctgggggtcctggggctgctggttgttctgggtgctcagtgtccagaaaagaagatggggaggaggctttgtgcaaaacagtaaccatactctataaattattttttcattagcctttgtgtcataaaataaaatataggactccaaaagaaaaaaatgtctaaaatttgtgtcctttaatacaaagtaaacacccattaatcaccagggatagatgtttgtggggcaaaccagaagccccatcatttgctccagcccagcaataaactctttcttccctcaaataaaaacacaacctgacttttacgatcatcacttctttgttttatttttatttttatcatccaatattatgatttagttttacctttagaaatatgcttttgttttctttattctatagattcttccttgaaatttatattgtgtggtagagcttcccatagtgtgcattttgctgattgctccccaaggcatagtttaatatgtatttctattatctgtattgcctctaaattggtaattggctatggagatcagcttctattcaggcttggtttctttttcacttggacttgtttgatggtgctgtattgtgttcttccatcaagaggaagaacctcacattagttttttcttttattgtgttgttaattgccattgctattcaatggctaaatctgttaattcatgatgggttgcaaaagagttattatagtctcagtctctcattccttcttcatttattatctgaataatttctaagtaagagattcaccctcctctactgtttgtttactactagaaacttggttttt

SEQ ID NO: 10794 - DNA, 186191 bp, Homo sapiens
  misc_feature (1)...(186191): n = A,T,C or G, or insertion/deletion polymorphism (see Tables 1-2)
gtgaaaggaaaaaagaaagcagaggtatttttttttttagcaggatgttaatccacggagggtcacatgagcgctgcccgggcggcagcgttaatacggcgaagtgcataaaattgccatttgtaatttgaacctcctgtacaaaagtacaatctcaggtttttttttttttttttttgagagggtgggggctggggaaaggggtgagggggagggacatgttgaacatgcaggaaaaacaagggcagagagagagaagtaaactaggctttaaaacaacaacaacaaacaccccatcccttgcagaaaggcagactccagtgaactcacaatcaatgcaaaggaaatggaaacagcccaaagagagagtaaagaaggaaatcagtcggccaaagcatgcggatttggggtctgggttccaatgcagaactcgcttctagtataaaacccttttccgctgcaatacgaagagaagagcttggggcttcttgtccttacccagagcaggctagccaaacgtacccaggaccccgggacccaggacgagggaaggagaaatgagaggccgataccttcccgtctcatgcccactttgaggcactttttgaggcggcagtactggcactggttgcgatggtgctggtcgatgggacagttccggttggcgcggcacgtgtagctcaggttcctccgcacgctgcgcttgaagaagctcttgcagccctcgcacgtgaactggccgtagtgcttgccgctcgacttgtctccgcacaccacgcactcgatgtgttgctgctgctgctgcttgtcgctacccgggccgccagggccgccctggccaccggccgccgtctgggctggcgtgctggctgggcccccttggccgggcgtctgtggcgtgtgcggggcgccgggcggcgggccgggcacgggcggcgcctgcgaggcctggctgccctgtgagccgggcacctcgtcctgggggtcgcgccacgtgctgactaccattgccatatctatgggggctgcgtccggacttcctgctcccctggctgcgggcggcggcggggcggcggcggctccccgggtctcgggctccggcgcgccgccttttgtgtgtgcgagggtgcaagagggcgcgggagggcgccccgggtggctcgggggctggttggttgaggttggttagtttttccttttttgtttttgcttttgcaaagttttgtcgatggcttgtctggcccggtgtgtttgttttgtttgtttctctcggctcagctttgttggtttcggggggctttccgccgggaggggaggggaaggggacaggagagcgagtgggagcagaacgtggagaaagagggaggggagggagagctgaagtcgattgtctggcttcaagacagaagtaggaggcaaaaaaaaaaatctctccaaagatctcgctcgctctcactctctccctccctctctcgttcactctcgctcttagagctggtgtgcagccgaggagttggcggaggaggaggaggaggaggaggaggaagaggaggtggtggtgaaggaggaggtagaggaggaggagaggcgactgtccgggggccaagtccagggcagcccacagtcagccattcaggaaagccatcgaaatcaggaggactaggagatcggaggcgccgggtgcgggcgcgcccagggagccaggcaggccggggcggaggccggcggcccgcggagtggccggagcgctgcccgggtccgggggaatcagcatgaaagtggtccgcgtcgggcgctgcgcggcgtcgtcctggcgctgggccgccgccgccgccgcctgccccgggcgtccggcgcgcgcctcgctctctccggccgccgccgcccgcagtcgctgggtggaggccgctcgccgttccctgcgggccgcccgggccgccgctgccgccggagccgccgccgaagccgccgggtcgggcccggagccgctgcgtctagcgccgccgccgccgctgaagtcgctgctgccgctgctgccgccgccggagccgctgctgctgctgctgccgccgccgcctcacacacatagggaaagagtcaactcgccggcggcgggggagaaatgataaaagagagagaggagggcagatcaccacctagaagcacatccttcgtgcgcagaggggggagaaaaagacggagagaaagaatgaaagaggggaaaaaaggcagtacggcacccggagaaaggaggcaactcggggagaggaggaggagaagaagaaaacacacacgcgcgcacgcacacacacaccgcggagagaaaagaacagagaatcaaagtgatcaaatatgctaaaaaggggggcgcgggagggaatgcgatttataggcgccggggctggcagaagtggcttctccgcgatcagctcactgagctctctatatagtgaactttgacacgactgctgcaacttagcgcacgttgccatggcgacggcgcgccttataaggcagcagccggggttggcctggccaggcgcgcgcgcgccgccccctcgccgtcattggccggactgcggcggccccgccatggcggccgcgggcgcagcccggtcctagcgcgagcggcgtcgccggcgcggcgcggggcacgcgggggaccgggggttgggggggcggggacggggtggccgcgccgccgccgccgccgccgccgagagggggatgggcccgtgctggccctgcgagcgctgcctctgctctccccacatcccgcacccgaggtttccgccccggcggggagactagcgcagcgcgcacacacaacgtctcttaaaggctccgcgagaggctttggatggaatcggggagtttgcctctcgcaacttggcgatgtcacgaattccgccgctcgcgcaccacccgggactcctggcgcatcttagtacccacaatgccaaagaaaagttccctggtttctttgcagagggatagggagtgagggtgggaaggtgccacgaactgagcttgtaggcattttccaaacgaaagagttggccagatccgggtgatggcaaacccttctcttaattaactctgatcacttgttcggtttggtgacatatatatatgacatatattcttttcagaggataaaggccgttctgtttctgtttattccttgtagggttaacatttcacaggtatgtggcctgacattttaattgcccaaataaagcatctcggatgctgagaagcagaaatagacttcatctgattgtcatgatgcaattagaatcaattttcctcaactttaccctctctcgctggttttagctaactctccagccaacatcctgccacacacccagtcatggtgagaggggaaagacctctgcccactgatggacaggaggaggcagccgcccagcctcccctgtkcacaccctctgtacacacatgtaagcgcacatgtatcagatgcacatttgtcaatgtacacagacaaagacttcaccgactatgcttctaggtcatagaacagttgagtacggacttcattgttcctcaagttccttttaagcattcatatagtcattaaaacgcacccagagrttctgccccaaatgggaaataatactagtacaggtcacaagaaccaaacccaagccatattctacctcaagaagtcactgcaaaaagaacaacttcatagcctattgccattctgctccatgtgctaaaataattgagacagttgtgtctttgaattccagggtgtctggttttaaacatcaaacatgtagaattgctctcagaacacactatattccaacgcagtaaacttgttgtttatgaccagttagtgaattatcattattccacatttatacaagaaaattgtgtctcctttgtacacactttgcaccaagaaaaaacctcatgccggtaaaccaaccaggtttgtgaacaattaaaatattttacacaaaagacgctgagctccaggaaagaaatgaacacatatgaagagtaaattgatgaccacagaaaacatccttggtagctgaaaaaaaaattgacagggtaaagatattttaaaaataaaccatacatataattgacatgcatagatcacattttacattcaattctctttacacacataggcagaatatgaggtaaggactaaagatctgggcagataggggctggtttttaggaaaggaaaaatcttctttaagcttcattcccgaaacctcagccctcactctttctccgatgaaatcacgtatttcactaaagctgcaggttctcggtttatttgaaagttgttaaaaaaaaaaaaaaaagcccagcaaacctatagtggacactgaactatcataaacctggtgtgtaataagattgccacagaatgaagccaagctgagaatttcaggttaattagagacacaatataactttctcctaaagaggataagaaggatggaaaagaaatcattacacaggagaaggtttttggtagttgttgttgttttcccttccaacctctatgattcaggaattgctaatgttacaaatgtcagcagattcgggacaagctcagctgagatgtgatgagactggggttgagataggaaatctaatgggcattcccatctcaatagaggatgaaaataattgattatagggaaatcttcatctcacctcctgaatgagacttccatagcagattaccttttacaaacatgggaaggaacaatatcgaggaggaagagcttccccagtccacttagagatttttggaatttgaagtatgcgtgatggccttagattaaaatggaataatttcccaaccatatcttaacaaattggagcctgctaggcaaatgatcacagggctgccataaagtcaggggtgtttcactctgtattttaggactcattcagttatgaaatgctgttacaagggagaaaaaaaatcaccgtatgaattatacttaattttaatgcatagaagaagagacaagactacagactgagaagaaaaaagggcaaaaatatttttaaatgtcttctccagagatgctcacttgctgtgcgtctaaggttaaaaagctctgagaagataaaatcaatatattattgttgttttttaaaaatccaactcagtctttttttgcagatgtaaatttattttaatgagaagaatggcaagctttaatttgcctagagaaagttgggacaacatttgccctaatctaaaaaagaaaagaaagaaactcaacacccaggaatataattttcttgcagaaagtggcctgatgggctgtatttctttacagattgaatcacaatatgaatacagaccccagcaaatgccgagtttaactctgaactcagtagaaaccagttccgtcctccaggattcattgaattcctcctttccctcaatctagtccgtgtgtgtttttctcttccaccacactggagctccatgaatagggaaaggggcttccattgtgyccctctgaacttccaagtcaatgcaatttttaaccactggcttgtggtactttgaaaatcaccaggggctgtcagagttaggtcctctgaaaaatttacagtgctaaatcagagcatatgctgggagggaaaaaattgcttaagattagagcaagtacagtatctgtctgccccctagtgtaagagtcctcgctgcctaaaattcaactttaaaagaaaaggagctcttaaagggaaacgactttggactcacgtaggcataggagaacgaaacttctgtacattttaatctgaataattcttcaggatttaaaattaattggctctggcttggttggaccgtactcggatctcgccacctctgcgtttcccgagtcactggcgaagaggtgatttttttttttttttgaactgggtttatgtgcgtccccctcaccccctcctctctttttctttctctctgtctctgtcgtctctctcgctggctttttaaaaatgaggaaccgctccttgaatgttctggacagagcacagaattgcttcttaagtcagcccggcgcggttgcaatagacagcaaaaaggtaaacgtttgcctgaaatccgcacgccagctccaccgccccgcccgatggtgagtacccttctcgtcgcgattctcctcctagcttaaccgagcgctcgcctacccgaaccgtggccgagggcgccgggctaggmttttctccctccctgcctgcctggctgtcagttgcacaaggttgcaaaatgaagcgcagaggcaaagcgaacagtaaattctgatacttagtgcgagcctagcagctcctttgctagaaaaccgagtcatctgctgcttgcaaaaccacgctttataggactggtttttagtttgctctgtggaaggaaatgagtttgaggagacaggacgaggagataggaggctccgcagtcttaacgcttcggtttaatcatattttggcagctttgcaattgtattttcccccctccccctccaccatctctcctaccacacacatgtaataaaatatggcaatgcattgaattgactctgatccccccttccccgaaccccttaaaccacagtcctcggcatttcatacacgttagcaaaccgatattttgaaaagccccaagtcatccccaaccccacacagcacaagcagaaaagtgagaaaggaaagagagagagaaaaaatactgtaagtaaacataccaaaaccatatttgccttgttcaaggtcccaaaccgcttgcatcttcctcctaaactggaataactctcctttagtttggcgggtgaaataaatgctttgttggccccctgaaaagatgtgtctttgataattaaagagaatctcctcctcggtgtttatctaagcgattgtgcaaactgataaaaagtaggcactagcctgcagggaaaaagaggaaaggtgaagggagagatcttccacctcaaggaagtgcttccccatgtattaggctctctcagccttggaaaaccctgcacactaactttagagagacaaggtttcagggagctttgtacatagctgctgaggaatgcaagcctcgcctttaagaaaaaaaaccccaaaccgtaggtaggagatgtctggagtgatccttgtctctcatctcattccttagaaggaagagtgcgttgttacaccttgtttggggctggaaagacgagactttaaaaacacccgtccaattgaaaaaaatctcccaacttaatgagtttagtcggaggctggagcaaacggctcagcctcagcagaaaaccgccaacaactataggcgatattgcaaagcaagacgacccaaggcacagccaaattccactgtttggggtcgagagagatggaggctaatcctaaagcaagttgggaaaaaacagaggtggaagaggagggggaaaaagcatcagcctcgcagactggcagacaggcttccctcgtcctggatcaaagatagaacttgagacaagagggcaacatttttcctaggaatcctttggaatcctcattttctacttttaactcaagtctccccaagtgatttttccccctctcccctgtggatttctgcctcccccctttccggtccttattctagaactttcctgaggaggaaatctatttcttttggggggaggggttccccattccatgccttcagataatgaatgcttcattcaccccctccctttctctactccccaaaacgaataaaggaagcaagaatacggtaactagtgaaaattgaatataaactatgctgcctctcacagtttaatactgtcttaactaatggatttttgttttgttttgttttaagagaagaataatggggaaacacggatcttttattttaggaaactgttatggtaagatgtatgtcagacttgacaaatggaactaacgctcttcggctgcttcttgtccttgtcttaaacaggaattaagttaaacacagtgctgaatgttaattacatgtttactggctaatgaaaattacaaatggttttgccacctcaaacaatgatgaaaactctgaagacactgtaattatatactttgagcaaaataactcagaatattgatcataagaagtgtaaatcttttttaactattcattaataccataaatatgggctacagaagtttttccttgcggtttgtctcatcagttatactgagtggatggatggtgaggctcctctggggaggaggtgaactcattctcttagtagaaggaggccacttgtgtaactcgggggtgccccctccctttcgcccccgcccccttcatccccagccgaaggtcgaggaatagttgaacaggaaggctggactcagggcaggtgaagatgatcacagcctggccttttctctcccctccctgcccatctcattcctctcccttctccctttcctgccagttctgatagatgactgccttccccagctcgggcaccagtgggataacctggcattcgggggttcctaatggaggaccagttagaccaagaaactcacccccacccacaacccagccgtggagccctgacaacttcaattccctccttcagagatggctcaggcagttcattgcaaaagaagaagaaaaaaaagttagggatggaggttgctattgggtaaggtggctcaggcggctgaaccagaactggtttccctgggtttgggagcagaaaaaattttttgttgtggttttcttttaactttggccaaagttgtagtgctggcagccactcggatctaggaggtcaaaggtgagggctgcactaaccctaaacggctgtcctggcctggctacaaggccaaacaggcaggggaaagggggtttgtcagccttgcagcttggcactttggagggggcatctgtggaacccatacttggggggcacagcatcaagtgtgggttttaagtgaaatattgaggatttttttttwaaaaagtgccctaggcttgtgggactagagtcctctttttccctgagaattcccaaggcgctggtctttgtcttagaaggaatggagtttctgaatggtgtgaaagggacagagagggtcgcttcaaatcgattttacttgtcctttctgtcttttcggatcaacgcccttcaatgggcacagaggtgctctttcaaccaaaaacttgtgctacattttctgcctgtattggtgctaaatacaataagcactgggcagggttttttttttttttttctttgctctccaaagcaagaaagcaccctaattaaattgttttatatggacagtcaagacggaccaattaagtatgcattagtataaagatatagtctgcagataaggttgtttagaaaatcatgtgtaggacaaaggagagggcgctagcattttggagaggtgcctagacccagcaaggtcatgccccttccttcttgggccccaggggaattgcaaaggcccgggccccaggtgagaggggaacaagctcgctaacaggtgggcgacattgccggagactttcaggcccgaagccccggcccaagagtagtggagtccgagggtcgggattcctcacatcttactcgggcaacgtagcagaccgaggtagcgctccygtaggacgcagcgggaccccgcagtgccctactccaggtccacggtgcggccctgcaataatgaaatcgtctgcgcccggggaaggccaggagggccaggggacacagacggtgtcacggccgcagccctctcacagccactatcagggcaggaggcctccacctaacaattccaagctaagcgctttttctgatcttaggaaagaggaggagtttttctgcgaggaaagtaacgcttccacccgacgccatccggcccgatggacgtcgaggatcagtctccagagtaggagaaaggccgacgggtcggagaaagggtagcagggagagcggctcgtcrtccagcagatgcagctctgggcttctccaccccctctcctccctcagaggtgtgggcgggcggagagcatctctcctcgaaggaggcgacccccatagcaggggccggggcctccccgcgtcgcggctcagggctgtgataggtggtccccgggccgagggggcgcgagcgccgcgcgttgctgctggaagggctcgcagggcgcacagggcaacccttagtagggcgggagggaggagtgcgggcgagaattagagcctggggaagtggctgaatgtcaaaagtaaaaggttgaaaagccaattttccaggcgcgctttcgccccccttagctggttgcaggggccgtaaatcagcggccggcggcgagggcgggaggagccccctcggcgagctcggcgcrgccccgcccggaccgtgcgcacctcccggtgggccccgaatcgatccgaagcccagctaaggatgtcagcgcactaaatatttactgatcacacacaaatagccggggctcgaacgattttcctctgtgaggagagcgcggagagaagggtaaatcattttattagtgtggataaagcccagagcacactccgggctggagtgttttaagatgtgtcttcaacaggatgaaaagagttagggaaatcgataccgagtgattagaagcccccggggtgacgaagggggactgggctttcagggatttggcgaggccgagaggggggagcaggcctcaaggggggcggcccgaccaccgccagggagctcccggctcaggcctccgtccctccctcctcgacgggagacgccagggcgcagcgagctgcggggagtccactgcggccaggcttcgtggtgccggcgccgggtgaaggctgcgcgggccgccgcggggccgagggcttgagagccactggcttcaagccgcgagtggcagaggccaggcagccgcgggagtggattgcaggcgcggtgtgggaacgccggcaagtcccccgcacgcagtctctccagacagcctcggggattgaaggtgtggcctaaacaggttgcatttctcctgctggcatttcgggtactcctcccagccgcgacccgatgcaccctcgaactttctcccggagaaatctctacccatcctgtcttttaatatttttcaagaggtctcaatggcccatccccgccagctgcctcttcctcccacccactcggtgtcaggggcggccgccgggtggcggaacccgctggggactgccgggagagtgggttccaggttccctgctcgtgggcaggtgggacgacatctgaggccgaggaggaaggcagggggctgggtgacaggcaccgaggaagccccaggacgtcagcgtcctctcctaggcgggaactcagctttgggggtaccaggccacccccagcgatggaaacccgcccggggcccttggctgggtactgcgaacccaagtggccaaggagtaaaggctggcagggcttgacgaagttagcaaggctttgaggggagtttgctgggagggagagcaaaacccccaaactcaagcagcgaagccctggcgcgaaaatggcttttcacttctccaagcgcaagtctctctcgctactgtgaacaaaccttgaggttcgaaacagctgcaaataatcaagtaggcgcaaatttcgggaggggaaaggaggggcaaaaggtaagaaaaggggagaatctttttcgtttcttcttccttttcccgctcctggccttttcctaaatatctgcgctccctaaagcaactgatagctacctacgtttgtttatttatttagaaaggttcaccccccccccaccaccaccccccaattgctcgattttcttggcagcttgagggatccaatccaggctgccctgcttggctcttcggtgcaacaggaaatgtagctgcagatccaattaaccattttccagaagagaatttcttttttttttttttttaaatgaatcccagtggattgaagcgaccgtgttcaggtgtgaggctatcgggtacctcgcattccttccccggtaatcctccaattcctgcgttggaagttcgcaagccaagctgacctggaaggtgtcaggagccgggtgtccattaacccttcttggtcttggccagaacgaaggttaactacagtgatctaccaaaaagagacgtagcaaaaaggaagcgagggagggagggagcaaaggaagaaggatgaaaggaggaaagggtatattcactctagttgccagaattttagagctctgcccttcactggtcctctcccacctccacccttcctatgaaagcaggtttccattcagatagacaacagtctcatccatcacccgcagcacactccatggagatggacyttagggaataagaaaatataatatagtgaaatattttcttgtatttaactgaccgtctagtccatttaaaaaatatttctaaccatgtctacagcagtagattgccgtggcagagagttttaaaaactaaaaaaaaaaaaaaaaaaaactaaaaaaaaattacatggtttatttaaataaaagctaattttagaatcttgtcagtagccacattatagccataaaatctgggtgagattagaaaaatatattctgctggtttcaaacctggtggctgcaggaaggtgtatgcacgtgggtgtgtatattctgatggtgttagaagttccttgatggattaaaggttcatatactcaggcactagatagaggctgtcactcatgtgtactggcaaaaaggcagaaggcagtacaaaaaagagttttgaatgagctccttagaaccaccattgttgaaatacaagctgaagcaacttagctatggtagagctaccgtggcttgcaaaatcacagaaagacacttcaaagtaaagccatcagttttgcagtttggtagctttggcaaggcatttaaataaaaggtgagcatcttttgcctaaatatttaaaaattcagggatatgctactcattctattttacttttcaatggattgaagaattaaaggagaacaggctatagctagagatgatggcataagggggctctctgcccatttaaccaagtgtgatgtgggctatacatgcttttaatrctaatattatattgtaaggcaaatcctgctgagaaagttccaaagacatctaaagccatgtggacatcagctcatacttagtagtggacagagtgaggaattattgtctggttctatatttttctctttctcaagagtctggtaatgaaatcttttaaatgacagttaatttttggtatgtaaaaaaaagcattaatcaaatgatatcaagtgccagtcatttaaatgtgaaggtgttagtaaggcaaatacccagataaattaatatggttaattagctgcatcagtagtactcaaagaaaatacaagcagaacaacaaaagggatctaatttaattttcttaaaacacaaactcaaggtgaattgcagttggagaaaaatagtttaaggagcgatttccattctaytggtttttataaggttttttttgggggggggacagtttcaatataaaggagtaagtaggtggacagagacagacatactgtcataatagggaaacatgcacaaattaattacaacctcatttctcctcttaaaaggctgatttcttgaaaagttgaaggtgcatcttaaaaataaataaagaacttctgtgtaaaattaagagaagactgtttaacttcatattcagcttcttgaccataggatgtattagcttgagaatttacaaagtgtattgtttaaataaaatttatacttttctttttagtttgaatacaaggtagagaaagatacttttcctatccatctattataattcataataaattaatcaaccttatctaggagatttctatgtacttgactgaggtaaatggattgagaggaagtcactttaaatagtttaaagcaaaactgagaacattaaaggaagggaatattgaattcagtgaaaaatgtcacattggttatttcttggcagaaccacatcacatcaccgtcagggagaagaagatagcaaaattggggaagcctatttctgtgtagaatgtatgttaataacttatttacttctaaaggtatgttgcaatttctttgcatatactttgttgccacattaccaagtaattaaaaagatgctactattgtgatatttaagtagtgaggattttaaagatacttttcttcttagcctcctctgagtgataaagacttatgcctatttactcattgattttcttacatgtgattttggttaatttaatggcttttaaaattagatactattttgctaaagtctacactgtatataaattgaaaacaaattcaaaagtatcaaatctttttcaggaattgcaatttgaatgttcagttattgaagagctactatttcaaccccccaggttctattaaaaacaaacaactaaacctgttcttctttcctaacaactcttaaaattgcaactgacatggctgtggatgaatgaatatttaatatgagtctttaaccctcctttcctatttaccctggaaatgcctttaatttgtcttttatgcttacgtattttaaaaagcattagtcagtatacaagaattattcactccctttttaaaatcagtgaataaaaattctaattatagaaaagaggtgtgatgtttattctgaagtttcagtagcatgctaaggtttttaaaataaactagaagaaacactatcctagataaattaaaatagggcagttgttgggtagggtttacattcatatccttctgcctttttgcttttggtacaaagatatttgggtttttgtcttcacatactgtctattgttaacagagtgaatttttgaagttaaaaatattttcaaattgtctcgcctttatagtcgaatgcattattaaattgaaaaaataatattcacttttgtgttcaaattggtatgtccaggcaataatgagaaaggtatgttctgtaaaatgtctcctcccctaaaaaacaaaacacataaacattacataaattaagctcaagagaaaaaacaattcttaggattcagtgtgtttgaacagtggagctcttaataagtttttaaaatttttttatttttaaaaccttaactatcttctaagatgggacacttcagttttacagttttatatactttttgaatttaaaagcaaattttaacattgcaggatttttgaagcgcagagagatttgaaaaataagcctccaaaataaaagacagacaagtgacagggcatgatgtcttgcctaagtttttatggacgttacaaaagttttcttttaaaaattacaataacatgctttttcgtcaagtacaaaataagataggagggaaaaaaaatgaagaaaaagtctccctctcactctctcccaccaaaagaccccaaacaacaacaaaacaaaataaaaagaaacccaaatcctaaaccccataaatggagccccttaccatgttgggaaagtttctgtgcaaactgaactgtttctgtgggtcctgccaagctcctggctggtcaactttttaaacacggcaggcaatggttagactgaggtgagcagcctggcagcctagagaaggaggcagactagagctcagctccagagacctaccacttagagggaaagttgggaaagcaactgttgagagttaacctctcctttccaaaggaggtttgcagaggcaggacagtgagagctgataccaccaattttattcttttctcaggcatttctaacttttatgatttcccccctccttcctttactatctgtctttgtgcctccagggccagtgaaagagcagggcagattctagattgctttcagagtttgccttctctgatgatggattaccatgtcaatttaaacagcataggattaatttgtttcaatgatttctctttaggctgaatgccagccgtttttctatctttctctttgctcttcagaacaacaacaacaaccaaaaaaaaaaaaaaaagccttctttccatattctaagttaagagacaataatagaaatagacaagttaggtgtaatgttgcaacacagttataggtctgagtgttttttatctctgcctaagaggctgaaacatacagtcagtcacattaaaatgaaattggactcaacatttattcaataaatacttgtcttgtagataatccagtgccgagtgcttttgacatataagaacttaatttgtcttggataacaagttattaatatggcacatttaaacttgccacctacaataaggttactgagctctacaacaaactcaaatgatcattgtgaaaaacagtttgtgggaagaagggagacattttttgagaatgcttatattattatatgtaagtatattcacatacaaaccagtaacacataggggcacacatgcatgtgtacacactctccccaacatatgtgtgtgtgtgkatatatatatatwcatatatattcagatcacatatgacaaaaatgttcagtgaagttaaaaaaaagtccatccattatacagatgtatctaacctttcctgaataagaatgtgtcagagaattttctcttttgaaagatttctaaagtgcacttgaaaaatgctgttcaaatccaatttttttgcaagaccaaacccattatgaggttgaaaatgtcacagaaaaagcacttaggtgcaatccaaaatcaaacaacccctccacattttttacctagtctgagcttgcagccagccagagcatgttgctggtagaataaagccaatttaagtgaaataatctattrctaaagtgattatttaatttcccgctctaacaggaggtcctccaatggatgcaaaaggacaggagagacatttcatcctatgcactgaatatattgggcaaacatatttcgaattacgggcttcttttccaccaccctcttctaattgtctctccttttcccagcattccctcacactgaaatttacattatagttcagaatagtaaagtgcattttgaatatgaacacaaatggattctatagccttccccttttcctcagccttctcgatgcacaggtgggctttattcgaacaggttctactttctaaggacatgcaggatcagaggccaatgactgtcagaactggaatctatgcaattttaatttgtaaaaaaagttattggttgctaaccttgggggagattgtgcatctctaagaaaccaaatctttgagtgctctccctgggaaatgacgttacacatgagcagaaaaatccaggcaagaaaggctaattgaatgaagagagagaattaggttaaaaaatagagtacaatctagtatcacattttcactagtgtaacttgaaatgaaggtgtcttcaagtcgccagtgttgccagagtgtttagatgttggccacagatgggaacacctattgaaatgtgtctgaagaagattaatagggcttgtcactgttgggaaagcactgctttgctgtaaatttctaccagcacaagatgaattaccgatgaatgctcacttatcaaccctatcactatcgttcgacactaaatcaaattgagaagttatctgcaatcagaaaatttctttttaaaatagacatacacttttaggccccaattctttaataatcccatgtacaaaacaattccccatcccctgatgcttctttagcttaaacaaaattatatctcaataatgaatatatttttaagtttatacacaataagcagctggtcaattgcaaaggttggcagtatttcagagagggtatgaagscttcttggaggtcatcatttaacatttcataaaatgtttgtgtgtgtgtgtgtgtgtkttttaacttttagatctttctctctcttagttggaaggcaaagaagagagtgagtttactgttctaaaccctgtgacctaatagtcctctaatgctccggtaagatcaaattctgagagaaatgcaagtttaagtagagaacagtaaaattgaattcaacagatggcagtgatacttggggacatgcatttattcttttgtgatttaatggtattttaggtatctcttttttaagttgatttatttgagaagcaaagcaggggcatgatctcattttattatttattaaccaactctgagcatccagaggctttccaacctagggataattatgttttgataaaaccatcaacaattgtgttgttatagggctctacctgtttaaaaaatgtggtcatatgcatgattcatttgatttttactaaagtcctgtacaagaagagattttgcattcccattttgctgatgagtaaactgaggtcatggagccaataggagcacagtcagaatttgaacctatttctcctgggttcctttcaggattttttcactcatcattatgtaaataaagaggaggatgatgatactaatagcagctaacatttactgtataccagaactatggtaagcatttatttatgttattttatttaatctctatacagctctctgcggtaactactgctattatttctattatccaagagaaaaaaaatgaaaaccaaacagratgagacttaacagagtttaaggacctgcctgaaattcacattgttagtaaggtggaggcatattattccaatccaggaagtcagaattcaaagctgctgccctatcctatgttcctgtttccaattacaagaagtcttaaattgtattgaagggtcacaagaaaccccacttcttttcagaatataaaattccttagactctgcagcagtgtgtcatggcagaataggcactggtctggaaataaggagaccttggcttaaattctagctttaccagttactaagtaggtgacctcaacctttatgccctttactttcctcatctcgaaaatgagtcggttgggtcaaatggatctacggacattgcacttgtgtgcttctctcccttatggtgcccaagaggaaaaaagaggaacagagaagcaacagccacctatgcagaggtgagtaggggcgcgtgacacagtgcactgtgagagggcatggctcccgcttcttggagactgtcttgaggacactcagcattagaggaagtctcctttttctttttcttgactccagagagcactgaatacttaaaacaacgatggttctttagaaaaccatagaatttaaaacttgcaagaaaatccttacctccattattttccaagtaaaagaaaaaaaacaaaacaggtctgtaaaggttaggggacttacttagggtcattgagctggttggtgatgcagttgaaactggacccctttctcttggcccccaaaccaggaatcctcacctcctgaaagcatcttccttacgctatgctccttgctcaacaaaagatactttagattatctgatcatgtccctatcataaccatttccctattttatgatgtgatacttttattgggttattattggctgtaatatgaaatttttctaggtctctctcacaatagtttttcataaaacctattaaactcaccagttacatagtggaggctgcgatgaagaatcacacaataataagaatattctgtcatctccattaagtcacaataacactccgatctgtatttattacaatgctcctctgatgcctccatcacccaaattgctagatttatattctctaatggtcccccaatgggaaaaacctgtatttttaatttttgttttcctgtcccaaatcaccctttcatatcccttgcctgttttggaacctccgtctggatttaatcagaagttgcaagacaaaatgtgcattattaagaaatataaatattttcagaagcaatcaaagggatgaaagattgattcagcatgcagattggacctaattcgaagcagctttgttctaatgagggctactgggatagaaagtcagaagccattgtgccaccagttagttggaaattccaatgcattagaataacctgtcaggatttctcttgctagataggctgaaaacactttttgcaagctatgttccccagtctctgggcaaaaccaccttccttgccacccttagggacttgtaataggtaatagtcatctttgagaaattatgactaattcattcttctcttcagagttcagatcagcaagtacctcccttttcccaactcagaagctggcttagcattaactttcataagaacattttggcctcgaggcatctgtattacaatttctttcttggcataataaaaggtatcacattatctacctggtcaatctctattggctttcaaaatagagacgtggaaaaacctaataagcctcattaggatatctgctttaaaaacaaggctgccccatttagcacattgctgtgaaatgtcccagcagagctgggtggtcattgcttgaatacaggtattgctaatttgggatctttgttagtctggtagctctgaaaaaaaagcctaatgtgtaggtggaattttaatacacaagtgatcaaacccagattgttgtattttgtttttgttttctttctttcctttaatcccacttcttgtccacatggccatgtgtgagagatggcttgattttcttgatatggttcacccatccacagctggaattccagagatgactgaaaatgtctttaaaatcaacacaactcagggagcctgagagaacaagttttcctttgttgtagggtatagtattatttgctgtaggttttttgatatacattctaaattaggcctgcaaaggcatgcttcatctttaattcatcactctcagctgaaagagattagcaatgtctagcacgcacccctcgtatggtgctgacctcatcaagtatggcctgaaattaattagcctcattcattcaaaatggaaaaggataatggaggcgcattttagagatgaccatcacaaatcgtatgcggcatatttaaaaggcccctattttcaaaccatgtagattaaaattctttccagggcttacaatatgccagagttatcaaggatccagagcagagcctggtcagatttcgtgtatatatgtgtgtgtgtgtgtgtgtgtgtgtgtgtgtgcagagtcatatgttccatgaatgttagtgcctgtgtatggctgagtccatagctggcttgttctctaggatgacatccagaatatctgaccaacaaaaatctgatgtttcatactgttttatatggtccagtagtagaacacattaagtgaaatttgttgttgctattaagtggaatatgccagcacaaactttgctgctatttttcagatactattcatgctttaatttagaaacagaaaagcctcttaaagaaatgttcaacttttctattttgagttatttttaaagtttctgtcttttcccagtctctactgtttgatcatattttaaaacatgatttaggactacgttagattacagaatcgcttaaatttaccatcttgctaagattagctgatttttctcttttggggattgactaagagcagccaaatttttgaatatcaaaactgctttcttttctagccaaaaaaatcttgaccggggttcttttggattctcaaagatgttgtaaagcttatttttatgagcagtggttttgggactacaaattcgaagaaaaaaaatgacttttatgtttccaggttttaatttttaaaatggtataaaatgtggttaacttatgaaaagatagtagtggtgtttgaagggaattttatatagtatacatttctaaaggaaaaaactttatccaaatataactttgtttagttaaattaaaaagtaggcatttagtgtaatgtaactacaaagcttctacttaactgctgtagtgaaacaggcagttttaggcaaaataatcttttcagagctcatcgatatactcatgtccatatgtaagttatttcagattattttgcattataataaaacagaaactggaagcatattgcccatgtctctgcaaatttaggatgtagaaatttctctaagctcacttttgcttaagctccttatcctagaaggcccctgtgtctaatgggcatatatcatttatatgtacaagatcatcaatcacgaactgtgaacctatcattttgacataaaatatctagccttaaatcttcccaaacctctagcatataattttaggaaattagctagcttaaagtctgggcttctgacttgtgggggatgaaatgcaaaaatgaagaaagcttagattatgcaaatttgattttaaaatcacagtttaacygagtcagggataaaactgataaaaatgcagatttttaaacgttgatggaaacagacaattttgctaattattttctgatcagtttggaattgcatggcaaataaatatcatagtagataaagaagaatattctccaaaaatggtttgactcactgaagcacattttaccaataatatgatattttctccataattatttatgattgagacaaaggaatgtatgcatcctgtaatgttgcaacttgctcacatactgaacagcatgtctcaatttttatttaatttttttatccagtgaggtgaaaatggcagaaaaactgtaaatacgaggattaagctgtatgaaatttgagttcattcaaatgacaaactcaaagtaaaacacagatgaacttaccaaatttcatttggcgtccacctgaaactgtaaatcttctcttggcatytgagagtagaaaggaggttcacctaaaattcaaaccaggttttcttaaacctaacccagacttactaactttggggtaaactacggttgcattttgggttcataataaaactttcatcccactttagctgatgataaatagatgatgggttgcatggagtaaactagaagatgtttttggaattgctgttttatcttgttttatttcataatgttctgaattagggaagaaaagtatataaagcacattttcaatgatgtatagggaaagatgaccacataagactgtccaaaagggaaaattagcagcatttggatgttaagtatacatagggttttctagaaagcagaatgaggatgaaatattattaactcacatttcttgagtgcttacgataatcaggccccgttttaagcattttacacrtattaactcagtttcgtttaccatagaaagtactaggcaaatactatcactcccattttgcacaaatgagaaagactactaggcatagggaagttacgtaactggtccaaggttatactgcttgtaaaagtgatttgagccccagatgtctggttctggaatctctgtacttaagtacaatgccatacctcctctctagagaaaatgcattcgcaatgttgtttgaaaacaaactgctgcagactgtgaatgggaggcatgctttcccattttttaatgactgaggacagtagtaaatttaatggagaaagccaaagtagacaagctcattcttgtctaatcttcttatcccagaagtaggaagggagttggtttcccaaatctcctgtaagtccttgctgagcttccacttggaaaactacattacgtaggatgcctcagtgctgaagagatagagataaactgagtggaattcaaagaaaaaaatacaagaatgacagggtgagaggagaagataaaaagaactggacaagtagaacgttggccaaataatagttaatagagaactcaatagtgttctagaagtatttagaagaaaaacaatggcctaaaaacgtcactagggccgttggaaagaggcaaagaggaaggtctaagagaaaaataaattaagagaacagtgttagattttgtcattgtctcgcaagacccactgtgtaagttatattttcttggaatgctgaagtccaagccagggatttcacaggaaaagaacattttattcctttctttgtgtaggttgaagcagaaagataggcttaaaaaatatagttaaaaatgctttacataataataatgtgtggaatgtccccctaaaagtaataacctttatatttaccatctcatttaatcctcataataaatttacaaggtatatactattatctctgttttacagatagagaaacaaaggtttgaggggcccagggtcagacagtcggtatccctaggaatccttcccaaggctggtctcttcccagaacaccacgctgtcttctctcgcatgacgtccccaggattttgctcaggagatgatgtcacaaaacaactgattttaggccaaattcattacagcacatcacccttagggaatgttttgatgagagcacattatgctggaatcagacatagccctgcttctgaaatctgaccgacatcttcaagaggtgaccgagtctgctcagctctttcagaagctgtgcatgttaagtaaacacatagtggttggcttgaatgtgggatggacatgggaaaatggagtggagctctcgaagtaggccgcaagcctcctgtgtctgcaggcccccaaatgaaatcacttagctgtttataggagccttagtgccgatgaaaagactgaattatacttcaaacttttccctgccaatggagaaaagttccagattctttaaaaagtatgaaaaccatcgatccgaaaagtggcaacagcatttgggaccaattatccagattaagaggcagcaatgatctgtttacactttgtagccaagagccctttggctctggtccacaaactggagattgtaatttacaggaatttcagcctaacattgacttctcttctgacctgtgtgtctgaggatagaggaagcctacatgtagcgaaagccctgcgttgccttccctaaaatgtcaatgcatggggaactgaatatcatcttctaggtaacacagttagcacacagatcccctgccatgaaggcatgggttttgtcattcaggaagagtctaattgactgtgtcaggatatagcttttcaacttgccactcctcaaaaatgrtatttataaaagaagttagaaaataaaggctccctgccatcttgtgcttaattaccatagcattccaatttaactctaattttcaatacattgtggattaatcagtcacaaatggtagacagtgaagttattaccaggagaactgtgctgctgagaatgatcagacataagattgtggcaaatacagatattatgggctaaaaggagacatttagaacatttagccaaaactccaaaagttgaagttgatagagatttgaaccatttgggatggagatgcatgtttctccctctacaaaggaagaccagtctccattgcataaccctgataattccagaagtttttgaaaatattggtctttcttttaacataatcctgatgttaagggcttgaccttgacaggaggtaaataaccaagtgacaaggaaaagaaataggaggtatctattcctgaagagcaggactgcccaatgcagcagtattgaaacgacaagtcatgattttacctgtagctatagctatgcggatgtgtttagagttaaaaaaaaaaaaatgtaaccagggctgggagtggtggttcacacctctaatcctratactttgggagggagaggcgagaggatcacttgagcccaggagttggagatcaccctgggcaacatagtaagaccctgcctctacataaaattaaaaaaaaaaaattagccagatgtggtggctcacacctatagtcccagctacttgggatgctgaggtgggaggatggcttaagctggggaggtcaagactgtaatgagctgtgatcgcaccactgcactcccgcctgggtgacagattgagaccctgtctcaaaagaaacgtaaccacactgaataccatcttagaccagaaaattggaagtaagcacaggcagagattcagttgttctttttcaagctctgttggttggatagccatttagataaaaagatgacagaggctgtgattgtggagtattgtgtgagtcttggagttggaaagcgctttttatcccatcatcctgtgtgcacttaatgcagggctaacttctgaggcaactcaaatatgatgccattccaggcccttcacaaatcaacatatatttctgataaaaactggtcaaaaaacaaactttattcaatttaggatttttcggatcctggtttatctcaacaatttaccattttctgcaatgtcagagcttcctgacatttacaattaactcacaaattaacttagaaatgatagtaagctctcacctaaatgatctagtggccactggggagcagagcaattttctagaataaggttaggagtaagttgctctgtaacgatgttaaggttggttgtgtagaagcagttactcaagtgtgaacaggaatctaggtgtgagagggagtcattgcctctcattctggctggttactcagcactctgacattcctccatctataaaacagataatctgcttttaaaagtttttggaattcaaggctccataatggaatcaagaagtcatggaatcctatgcttggaaggaagtttggagggcattggtccaacttcccactgaacccagagttctggagatggacagatgatcaaacagatgcagatggagcgaatttcaggagttgcagagtcaaggaaggtaacataaatgtgagaaggtctgggtgaaggctgccagtttggccagggccaactagagagatggaggggaagggctcatgctctccaaggctgctactactggggaactttgtttttagaaagctttgttctttgtatgaaagcaaaaattgatgtattggaaatatctttctcttttgtctgattctatcttcagaaggaatataatgaaatctcatccctttaccatatgatagacctttaaatctttgaagactttcaggcccctcaatatactgcttttgtttcagtggctaaagttcacagttccccatatgacatagactcaagagatttgcttccctgagttggccttggtttgccagtctctttttttttttttttgagacggagtctcgctctgtcgcccaggctggagtgcagtggcgcaatctcggctcattgcaagctccgcctcccgggttcacrccattctcctccctcagcctcccaagtagctgggactacaggcgtccgccatcacgcccggctaattttttgtatttttactagagacggggtttcaccatggtctcgatctcctgacctcgtgatccgcccacctcggcctcccaaagtgctgggattacaggcgtgagccaccgcgcccggccctgccagtctcttaagaagtgtcccaaaacaagtaaattactcagaagttacatgaccatcagggacagtgtctgtccactgcgccatgtgattggctttaaatggagtctttcatgaaggaagagcctccatatcctggagtcaaatcttaatcatctggggcttgtacaagggatttattgcatttaagaacgtctcacacttatcctcattaaatttcattttgttttggctttgtggtagcttttagaatctgtctcctttatattttgttcctttacaaatttactagcatttttttttcttttttacggttttgcccagtcattgaactaaatattgcagatgccagggcttctggagtttctggggtctttggtgtcactagtgaatatgttgaaaatagttgcatgtttatttcttcagttaactcataagtagtggttaatggcagggtctctggaataagatttgcgagggttcaagtactggatctgccaatataccaggtgtgtggccttatgtgtattaacttatctgtgcctcaatgacctcatctctaaaatggggataataatgtaactatcacrtatggttgttttgatgattgaatgagttaagatatataaagcacttacactaatgcctggcacatagcatgcactatttattaatgaagataaaataaatcgaaacaagatccctaaggagagggtagtgtcttgtttatatctgtagctccagagactaatgctgtgcctggaatacatttggtgctaatatactgagaatatgatgaatgggtttccacagtgttttagacctgcatgtaagcagatactacagtcgatgctgtggctcctaatgctaacagattttcaacgtgattataaaaaagaggtcctgaccatggaaagagaagttgtgtacattcaacctcagaccatctccttggtggtcattttgccactaatctttctgtgaacgataatagcatcagtgtctttattgacctaatctatcatgcctcttttatcatggaagaccagaaaagacacacacttaagtctactctcaactcagaaaagaagaatgcattctgcttaatttgtgcttacaccagtctgagaggggatactgtctacttttagcaagaaaaggagcttaaccaaggaatgctagtgtttcctaatcagatcttcattttgtttcaacttttgtagattcctaggcctgaggcagatgcattaaaaaaatatatgattaaaaaataaatgttttagacacygttcacgatgtgaaagtttctgcatcctcctagctttctgtttccatcacaagtgaagttttgccatcagggtaggtcttgatttttaggtgcatatccatgtaaccctcccctggcttcagcttcagtatgttaaagccagttctcatcaggttgaaaatttaaatcttgccagagatatcttttacacgtcattccctttgaacttctgtccatgctaatttaaacacagtcggtattttcctccttctatattaaaacagtcgagctcaaagaataaaattcaccagtgttttctcctttgaatgtgttcagtaggtacccctgaagcaattacctactgcaagaggtgggaggagccattctgtaggagcaggggccaccggtaatatgatatgtggttgttgtgtgtgtaacgtgctaatacttttgacagcaaccatcctaaaggggtgtagcaagtcatttgaaatttgtacacagactgccctatccattacacatggcccatatcatacccataatctcccaagscagatatgctattacactcagcgggccaaggtctgctggtgcttatatacacataactcccactgactctgtgccactgagacacttcaatgggggttgtcagcggcataaatttagcccggtacactcacaaccacagcgggcacagctgaacagagagacctggctgtgtgttaaaaaggctgaggaagaacaaaaaagctgccagttttcataagaaatctyatccctcgagcattgagaactgtagcccgatactcaccacactctttatccttgtcccacaacctgccgatcccaggctgggacttggaagcagctaaaacagagcgggcatttaaaaaaaaaagtctgctacagggcgtaaaactgcgcttcgcatccaaccttattatgtgagggggaagaattccccatagatgatcttcagaacatttatttatcaaaatttaaaggagcatcttggaaccaatgacctttaaatatagaaaatttaagatacgtaaaacaaaggcacaaagatgctcaccttttgaaagtcactggtacaaccaagttgaatcacatttgttatgggtgttataacgtatcccatatatattgtcatgcgaatatgatgattgctatattaaacctttcacagtgatttccagcatgttatctcatgtgattatttgcaaggtctttttggcccctcagacatccccaaatcatatcttctaagtgatcagcttagaagctctggttgcagcaaacaccaggatttaatctttgctccttggagtcccggccctcacagctataaacaatgaagcctgttcctaatcatcgaagtgccgtcgtttggcaagcaaagccttggtttgaatccctgctttgtgccacaataagtgtgtatcttgggtatgttgccgttaagccccatttttctcatctatatgctaaggttaagacagtaacttcacagtaatgctgtgaggacaacatcagaacacttagcgcaacatacatgcaccagtgagtgaacacctgcaactgttgcaatgtgtgctagttagtaggcactcactaaaagcttccttcctctttttcatcttttcttccccaccatatcctaataatgcttatgcgagcctatgaatattaagaaaaatactatctttaacgaaacgtaactattattccatgaataacaaaggactatgcatttgacagaacacatttaaagctatgctcacactttgattattggtatagaacaggtaggaatgatctaatcgaaagaaaaatggaaaaataaagaataaacaaagaaccaaattagacattcagtcaagtatgattcgtggctatttccagtggagattttagctgagtttaggatcctgcctctctggctgttaaggtacagtggttaagagtgaccattaagaagttgaatgcctaattcattcagagttcccatagattttctttctcaatttgggaaagaccaaaaatcaggtgcaattctgttaatgctataaaactagtatatttaatgataatgaaattagaaaaaggaaactatctttttccttaataaatttagctttcttgtcatttcttcatttaaaaaaagtagttcacaatatgaggaccctagtttgaagtcaaattaatcatgtgttaaaacatggcaccattcataccactcattctgaaaacagtggtctaggtcatatttaaaaaataatgtgttcttgaatatgaaaaaattcaatagattaatttgaaaagtataaatmattcaacacaaaattatgcatttctctttacatattttcctatataaaaatattgcctcctccttgttaagtaaactcccattggcacgtgtaactcccatagagctcaaataggagatgcaatattgtgttttttagaagaaagtaactgaagtttagtaaattgaaaagaccacatgcacttgtgtgtgtgaatgtgtgtgtactgctggggagttgactttttttcagtttacaaaacaacctccagtttgaagttgcacttagaaaatgttagaagttaaaagaaaaattgaacaggatttggacaatattcggggactttgaagagtgtgtgtgtgagaatttggtagtgatgatggcaatgtagccacttccatttgtgtaataaaatcagcacaaataaaacaaggcttatctaaatataagttgaggtggtcaatcaaactcttaatggaacataaaattgatatacatatatccaaatrtacatgataaacttgttaaattctttttgtcctattaaagataattaaaaaataccaaaattcaaatatgccttctgccttcaaacgtcacttctttttatgtagggttgatgatcctggcctctcaagttctgggcttgttttgtagtcagtgaatcttgtcaaacagaaattcttttttaaaaaggtgttctccctcctcatccacattttgcctcgattttagtgatcctttcaccctcccatgcctgtcagatcatagcatcatatcagcctgcataaaattgatttaggacagtaagcatttcctccgaaattaaattctccatgaaaacataacagcaccacccaacatcaaaaaagcgtcacgggaaaagtgccagaagttgagctgaaatgaaggctgaatgctttatatcagggagaaggggaaaagggtcagacagaaagagaagcgaaaggaaaagcagggcaggaggagaggcatgaaggagaggagggacctaaattagaacaagaggcgatgtttattaataaccttactgacccacaggcccctgacacaaaatacattaagtattcttgggacacactggtctgtcactcacaggaggagcaaataaaatggtgttggaagctgcaractttctgagaacagataaaaaagaaaagaaaaaaaagccagaacaaggtgaaggcatagactcacaaactcaagaagmctggcggtccgggttcactttctcctgtagcatcttctccaggtagtccacctgacacctgcaaatttctggcaaagtaggactgaaacaaacacaagaaaatattggtgtttagttgcaaagaggtacagtggttaagagtgaccattcatggccattgcaagacatttggaaattagaggaaagcgtgaagaagtaaataaaaattgcctctgatctcaccacttaaatataatcattgtgaacactttgatagacattttctaatctttttcctctactttttttgcacacatatatttgtgtgtttggaaactacagtgcaggccctgctgtagtgtactattttgcaaactgcgyttcccatttgataagtcatagtaaatatttgttcattttgttaaaactattccaaaacataatttctttctttctttctttcttcttctttttttttttttttcttgggacagggtctcactctgtcacccaggctggagtgcagtggtgcaatctgggctcactatagtcgcaacctcccaggctcaagcgatcttcccacttcagctcccctaagtagctgggactacaggcctgtgccaccacacctagctaattttgtttgtttgtttgttttgtagagatggggttttgccatgttgcctgggctggtctcgaactcctgagctcaagagatccacccacctcagcatcccaaagtgcaggtttacaggtgtgagcgactgtgcccagcctccaaaacgtgatttctctgccagcattgcatttccttatctgtagaggctgtaactcattcattcctctaacctctagttagatattgataccatttgtaactttttgcccttataaaatcttcctgtgtatcttcatttcctctggatgaattattatatgtgaaaatcatggatcaaagccttctttctgttttgttgttttacttttggctacattttgtagagttgccctccaaagttgccgatttatattctcactcagggtgcatgtgaacaaacacagatttcaggaaccataattaaccctttccccccaaaagataagaaacatagcatcccattgtgttttgtattatgttgattatttgtgatgctaactttctttccatttcttgactctgtcttgttttgtgtgsaggtgattttgcatgctttttaaaatatttgtttatttaacatttgccctgtagttcyaaggaaattttcattaattttctattaaattataaaagttctttacatattaagtttatcaactctctcattatcatatattgcaaacattttctccattttgtcatttggtttttaattgttaatggatatgttgttgaatttaagtacataaatattttcctttattcttccttctgctttatgttttaaaaggctttgcctatgcccagagtaaaatcagtattaacctatattttctactagtgcttctgtgrctcctttaatttataaaaacatttaaatctcttatttatctggaatttttttttggtcattaaaatttcttttccttgttgatctaaatgtatgctattggtcccgtttctgtgtttccatgtttattttattatctttttgtctccatcatttttgccaaaattctccatttttattattgtaattcaagaatatggttttatgtctagtaaagtaagctctccctctttaagattggtattctaratgatgctttcttatttgttattccatargaatgcatcaagtttcaagtttagatgttagaaaatacaatttaagccaagcacggtggcttacacctataatcccaggtctttggaagactgaggtgggaggatcacttgagactaggagtttaaggctgccgtgagccatgatatagccgctgcacttcagcctgggcaacagagagagattctgattcaaaaaaaaaaagagagagartacaatttatagattaatgtgtgtggattagaggtctttttaaaaccaggttttctcatgtagaaataaaccatgccttctcatcgatcttttcatatgaacttctataaagttatagttccatcaggtagtttctcaatacaatctcccatttattcagtgctattgtgcatgcagtttccctattcaatttcatgacttcgctgagcaacattatttttttcagcattttaagcatttttatttcatatttgccactttactggtttcttattcaaataacttgtcaatttgattctcttgaatcatctaggtagataacattattatctgcaaataatgatcattctgttcctttcccaaatttatgtaatttctttatttttcctgtcttattgcaaaggattagaacttccaaattatttaaaaagattcttcattaggaagactttcagtatttcactgctaggaatacgctgtattttttataagctctggctcttagatgtgtttttggcttcaactttcattctccattcctgaaccttctgtaccctagtcccagtgtatggctccccatcctccctgctcagtgctgagtacatcttaccctttttgtatacaagaatgttctatctctgtacacacagcctcattacttatctagtgatgcttctttttgagtcataacacccatggttcacggcaggagaactctctttcaattcttggcccaaaaccataaaaattggaatcacccttgatttattcagtaaatcataagaaactacctcgctattttctgccaccttaaaagttagtgtcttgcgtaagagtttttatttttccattttaggaaatgctaaactttttcctcacatagaaatggtcatttcattttaattatgctggatttctgccagggaaaagtaaaactaacctgggaatttgcatgtgccatgcaaaaagaattgattccatgggttagactggttagaacgatatgtgaaaatagactgaggggaaaaacagcaatgtttagcaagagtgtttggttacatgtggagaggtggaatggtgaacctctccaagcagaggtggcctttgggatgagccacagcttaaaaaccgtgagatctcaaacacatctctgtgtcaccctgagtttccattttttcaactctaaattgagcatctttcccctgctaggataatgtaagaatcagagacaacttctggaaagcatctagttggacacttggcacytaagcaggcacttaaaagagagaagctgttaggttctggccaggtttgaaggcaggaacatgggccatgttttagataacaaatggaaagactttactatgaatttctacatagaactaaccccaaacatgctgtagaagtttaggatttagtcaacaggcattactgtactgggggtgccattaaagggctctccagcctctgcccaaggtagtggaaaccctgtcttctctcctctatcagggttggtgtttgccttgactgctgagtttattggatcctacttcctgtcccaccctgacggagcatgaactgtgaatgtttagattctgtcttcctctgagggagaccagaagggctcctaattttggtaaaacagtaaatttagtcattatagccatgtgcctggcatcatttaagaacctccttgtcagcaccccttaatttttccaatttgttagcctggaaaacacccctattagtatcaaacttaagtcttaatgaggggaaataagaatttacccctatcgttcccaaaatgaagacagagatctgtatctttttaaacataatgggaggtatctgtgttattgtttaaaatcaattatcctttattccatgctttttttttctattgtttattttatctgtcctgctttcccagaggggcagaattaaggcccctatttggtttttattattgtaatcagttaatagctgttctataatgccttacttattgtgttaattttctgtagttatatccagaggccgcttactggaagatcacattaaaaaaaaaaaaaaatagaagatctaactccttctttaatgggtccagtttccatctatagtttcagctgaaattatcgaacacgattgaattacaagatcattgaaaaaatatataaactgtagctactattttaagtatatctgtggcgagtgcaaacattacattagtatgaggacagtccaaacattcgtcatagtatctctgttgaccacagcttatgataccacttcctcggatctgccccgagtctgtcagaggtatgagtgtgtgctattgccgggcacactgccaatcattgtagttccatcgcataggtgcctaaactctgggtcccaaggaccatcgtcctattgctgttggagattttaatgtgaatgtcttatgtagatgttggcatttaaagaactaattctcaagttagaatggagcttcaaagcagaccaaagggagaaacaaacttacctgaaagatgacaaagggcattagtataataaatgtgacagaatgggccccatgatagatgcattctgaattagatgaatgtactcaagtgacaagagcttcactggggggtcagcactgtgggttctaggcctacctctaacatgaactcactcttaagacctctgggggcctcagtgttctcttttgtaaaatgaggaggtgttgagatgaaagttctgtttcctctccacattcacactctgtgtgatgttcagccaggagtgattctgttaagcagttcagcgaggaagagccattagcaggtcaggattggatcagaattaaaatgcttctggttcattgttgagtctctgaagatgggcatggcacttggcataaaacaagggcccattcgtccctttgtaataagttagtgttgattgtgaagcctaaytaaaactccagtttgagaactgttattcctatgatggctgagagaggaggtggagagagggctagaccacgaagtcacaggaaatggctgcatgaccctgggcaagtcacttcatttctcccagtcttttctcctttacttgtcacataaagagtttggaggagaattgtcaaagtagcttcttcttcttttttttttttttttgaggtggagtctcactctgtcacccaggctggagtgcagtggtgccatctcggctcactgcaacccctgcctcccgggttcaagtctcagcctcccgagtagctgggattacagggacctgccaccacaaccagctaatttttgtatttttagtagagasggggtttcaccatcttggccaggctggtcttgaactcctgacctcatgatccacccaccttggcctcctaaggtgctgggattacaagcgtgagccattgcgctcagccccaaagtagcttctaattaagaaagtcaatgaccttaygagaatggtcaaccctgtaaagcaaataaaaaggttccgatgctttacaatatccagtgtccagagcaggtagagtacattatctgcgatttaatgcttgctgggaagaactttgcggggatgggctgagaagaagaggaaggaaaggggaactgtaccctcaagtttgactgggactttcatgcaacgaaggaaatgaggtctcctgcaattgcctcttattaaggtagagaatgtatcaaatgctgtgtttaaatcaattcaatgccgagttcttagcacagtgcaccacctgttttggctgtttccatatcctggccatagtggtgatgtgtgagagcttttcctttgggcaatgccatcagagaaggaaatgaatagcaacaacatattgaaaggaagagagaaaaagttcatatacatttcaatggaggcacgtttaaggcatttaaaaagggcgtctgagaaataatgacaaagtttaaacagaatcttaactttgatctgattttcttctgtaaagcaatttggcacataatttttcaagtgctaaaccacaaattccaatagccggacctcaatgccttcatttgcatcttgggacttctattccccccaaaaaacgtttaaaaattattaaggtgattttccagagacattaaagcataaagcatttgctggtcagctctcataaaaactatagcagcatagaatagctgagattaaaagctagatttaaatcatgcaagggctcagttaatatcagcgcctaattaagaaayctgtaaagttgatttgatggagaaaaattctatcaaggtgtgattggaattttcccttccaattgctgttggggattttaagaggaatatatcctacatggactttggtattcataggactagctctcaaattaaaatgatgctttaaagcagagaatagggacaaactaatttacctaaagggtaacaaaggaggttcttaactaaaaataagcgtgatggattgggactcaatgttagactgcatttctccctagttttttaacccaaaatctctcatagttcatatatgtaaataacagactgtcatccccttgagggctaatggatattattctttttgtgtgttcccagtactccactcatggttcttagcacataacagattcccactaaatgtttgcatagtagaagaattgaaatactttgatcatttttaaaaaggttcttgcagagcatggtgctgttttgggcctatcttctgttcaataacttgattgattggccagttgtgcaccaactagggagcattgcacaggcagcctgcaggctgaattgggccagtgtttatccactctttaaaatcaagaaccttcaactttgcataacaatatgaatttctgaattccgaagttgtggcactgtttggtcaacagctgtgcatagtgactattaggaatagcagcccccgttaggcagggctccttcacaggttgccattattaataaatgtgatagattaccccctgcgcctcccaacrccaccccccacccccaccatgttaggttgcattctgaattagatttagatggataccctgaattccgttgcatatgactccaggctgacttcacattttttctttttttcttttttttttttttgagacagtgtctcactctgtcgctcagggtaaagtgcagtggtgagatcatagctcactgcagattctatctcctgaggctcaagcaatccttccacctcagcctcctgtgtaactggaactagcaccaccatccccatctaatatttgtatctgttgtagagacagggttttgccatgtctctacatgcagggggrtgagctcactgcaacctccacctcccgggttgaagcgattctcatgcctcaacctcccgagtagctgggattacaggtgcccaccatcacatccacctaagttgtgtatttttagtagatacagggtttcaccacagtggccaggcttgtctccaactcttgacctcaagtgatctacgtgtcttggcctcccaaagtgctgggattacaggggtgagccaccacacccagcctagtgtgcctttctatggctgttgactttgaacaagttaaagatctaagtgtgagcttaattgttttctccagcttcacaaaaagataagactctaagtgctaggcttcgagtgaatctgtagtgtgcacatttctacaacctcagtgtggctccagtgggaattgagccgaatctaagcactaaataaccctaatgataccaagtaggagctcatcagggagctgttgaagagtttgtcagagcttattaaaatacaatacattcacataatcaaaaaaggtacatcagtccatctgtctatacattcctttctgatattaaatttgtccagggacttttcaaaattacatcacctatccctacccctttctttgtgaataaaaatgtggcaagaatggagagcaaatcagaataatgcacgttggtgaaagtcctataattgaaatcattattgcttaagacaccattgctttaatcagccctatcataaatcaatgcttttcacaagtgaaggtttaaaataaaatgctgttaaacaaattgggcctcttaaaaggcatgatgcaattgggaagctacggaaaatggataaaaaagcgctttctgaatggattcactggttccagcattttgtcttccacttaatttaaaaaaatatattacctggtcctttcttagaaattacatattggaggtctataatggccaagcctttaacccattaaaaaaatttwctcccagggaacagttaatatttgacgtttaattgctttttcttgttggagaggaaaatggtttttttcttcttttcttgattgacttttcaaaaatcaccttgtgagctataaaaatggagatgattttcaaaaactgcggtacacatctgtgtgtatgcaagcatatatgtgttcatgtataaataaaatctcccatgtaccagaagctggtgcttccctcacaataactctgcaaggcaggtgtgactatctccacgtactgaattaggtggcagaggtctagagaggtgaaatgattgcctggtgtcactcaggtagtaagtggagcagggggtggcttgaccacagagccaaggaaaaaggtcatgccagtggtccccatcttggagtgcaaatcctctcaacctctttagcaagcgccagattcaggaatatagcagrtaatccacaccaccagcaaaagtcaaaagagcccaactctcatcttttctaagcattttaatgtgagtccttcatggtaattaaggtaggagaagccgttgaatcagccctataaatcatgtccacctggaagagagttcttattcagggatttgtgtgaataagcagggaggctttgggaggctgaggcgggtggatcacgaggtcaagagatcgagaccatcctggccaacatggtgaaaccccatctctactaaaaatacaaaaaattagccgggcgtggtggtggtgcgcgcctgtagtcccagctactcgggaggctcaggcagaattgcctgcacccaagacgcggaggttgcagtgagctgagatcatgccactgaactccagcttgggcaacagagggaaactccatctcaaaaaaacaaaaaacaaaaaccagaaaataaaaaagtaaaaaaaaacaaaaaacagggaggtcactgttttcttattagaacagtgctcatacagacatcagatgaattttggggcctccccaggaactgttttaaaagaaagagggggccagccagacattggtgtggagaaggtgaggaaaagcctccatttggttgcctagaattagaatatttccaagtcaacactgtcaatctccccactctgacatgcagtaaatccagtacccacaactaaagtgttttcttgctttctttttcttttcttcttcttcttcttttttttttttttttttttttagacagagggagtcttgctctgtcatccaggctggagcgcagtggtgcaatctcggctcattgcaaccttccgcctccccagttaaagcaattctcctgcctcatcctcccaagtagctggggttacaggcacccgacaccacgcctggctaatgttttgtttttttagtagggacggggtttcaccatgttggctgggctgatcttgaactcctgacctcgtgatctgcctgccctggcctcccaaagtgctgggattccaggtgtgagccatcgtgcccagggttttgctttcttttcttttgttccttctcttcccacaaaaccaggtattatttaagtctcttgaaaagctgcacaaaccaactgttcctcccagattatccctttcagagctcaggtgataagccaccttgggttacacctcccatgacttgtggtcagatgcgggctgtgtcactctgccttatcctaccttacaagaaaatatctgtgtgttggcctcaccaggtcccagttcctctgggaatcgtcctgtatgcaacatcttcacaagagtggcaggcagttgaatctctggccttcgtgggaccactggacatctggcagagaaccaggaaaccacggttcccttctgtgagtccctcagccggaaaactacaaggtgtgtgactgtaggatgaggctttttgaaagatgaagtacgacactttgagaaagtgtttggaaagaaactggctgatgtcgaatggaaatctgaacattcacagatttcttttcctagatatagaaacgcaaaagcttacatgtacacatttaaaaaaaattaaattatcttttctttcttgccttcctttttttccccgctttttttgttttttttggtctttttcttttattcctggttaatagtaattcccatttttaaccaaggagtggtaaaactgacactgtcatattgctgataggatatattagcaaaatccttttggaaattcatttgcagtgtgcatcaagggcccataaaaatgtatgagaactatgtgataataaggaaacaggatatgcactcttaatgcttataaatacataggcaaaatatacgtagtcatactaataggtaatatttattgtctacttaatatatgacaagcacaatgccacatgttttacaggcattgtctcatttattttgtacacagactttgtgtggtggatattattatatctccattttatagattaaaaaagagaggcctggggagactaattggtttatttggagtctagtgtgagatttcaacccatcctaattgattacagagcttacactattaatttataataccttatcattcctcataatatgtggttataagtaaaaaacaaacattaacaaccaaaaaaaaaaaaaaaaacccacaccagcaaacaaaaatcagagaagctcttctcttataataaccacatgagaaaataggaaagcttagactgagaaaacggccaaacctaaaaaagcgtatttgcaaccagttaataaaatgacaggtagccttcaacacttaaatgttttaaggtttttttttctctggatggggattagaccctatatgaatgatttttgaccaaaagaatctaattgatattattctgctaatttaaggagttcaagggaacaagtcttacatgtagttgcaaaggactttgaaaggactttgtccagacttaggtgagaattttcttttggactgggtcctaggttagtgttccttaactttcttaacttatattgtgtgagaacatagctgaagatattaatggaatctatggtttctctttctctctctctccagaaaaacacatatattaacattattcaacattttgctgtatatattttaattttatctttttttcaggaaactttgaaaattttaggtttattgctggtttaagatttaaackaaaatttccctttctgttttggcttccagaatgttctttatacctcagagagaggactttcctttttctaataattttttttttttttttttgagacagagtctcgctctgtcacccaggctggagtgtagtggcacgatcttggcttactgcaacctctgcctcccaggatcaagccattctccttcctcagcctccagagtatctgggactacaggcacacgccatcatgcccagctaatttttgtatttttagtagagatggagatttcactatgctggctaggctggtcatcttgaattcctgacctcaagtggtccacctgcctgggcctcccaaagtgctaggattcccagcatgagccaccgcacctggcctgtatctctaataatttaaatactgatgcagtttcttcagagtgttgtctacacctggaaaactgaggtcggtaaagtaagcaagtataatgcataatttagtttcaatgttttcattaatatgataccataccattgtgaacacttgtatttggttgcatggctaacaactaccttttggatttttcatgttagaatgaaaaaaatgcatggcatacatcaccaagaatcaaaggttgtgcctggcagtgtaattgactatgtaataaagagagaagctttgctaggtgagtggacagcataatgagaggctttgttcacatctgcagaaatgcattttcgttaaacacctgtgttaagcacaagcacataaggcacagtgatagatggatgtaaaacatgggtagatgatgtccttgtatgagattctacaaagactccgatgtgttgaggtttggaagcattcaggcagcctcctggcactattggctatgctgctaatgagattacaggcagggcatgatttcattccatgtaatatttttgtcattaggaagaggcaagttatttttacctgtcaatttctgttttttgaaattgaaaaattctcaggtacgaatcccaaaagactttacatgcaacctccatgtcctattcaggactgttcaaggagaagacagaaacaccatgtttagaggtcattggtccatctactctagaaacttccccttggcagtggtccctgcctatgttacagaagacggcaaaaatacgagccatcgtgcatctggccagttctgcaatgctctatcccagggggaaattccttcctcactccagctggtgaacagctatgccctggagcccaggacggacatgccttgtaactttttaacttagttagtgtaactaccaatattattcctattcatataaatgtctaatcctttcttgaatcttgctagactatttgcctcaataatatcctgcggcactgaattccacaggtagattatacgctgctttaaaaagtatttccttttcttggttttaaatttgttgctttttaatgtcacaaaatagcccttgttcttgcattaagtggcacaggatagaagcattacaaatggacccttatttcttccaagcagtttcttcactaatattaaaaccctattttcttcatatattttctattttggcatatataatcttgatttaatgaaatgatttatgtaattagtctcacactattttatgaacatagtaggcactggtaaaaagctttccttggcattcagtgtcatttattggacaaatatttattgagcatctattatgtgcaagaactgttctaattttggagagtcagcttcacataagactgggtcatttttctgaaggacttacttttctagagaaggagataagcagtaatatagtgaataaatctatgaacctcatggtttcagatggtattaagtattacgggaagattgaaaggtggctggagccgatttgcattgcacagtcagggagtggctctctgaaaagaggacagttgccatcagctgtcaaggagccccttatgtgaaatctccatgaaggtgaactccagctccgaaacaaygcccagtagttgttgaggctcaatcattatttgttgagtgcataaatgaattaaggttgagaaggaaagccttagttactaaaatcaccaggaatttactcagtggattcagggggatcatttcttgaatccccgtgttctgtaactcccaacactgtgggaataaacaaagcaggggctgtagttagttagactgggtttcaagacctgaccatggtccccagcttaccagctgtgtgtccttgggcaagttacctaattgctctcatccacagaaccctcctttataaaaatgagagtaaactttcttccttcatgggagttggaggtttgaaggcaaagttaacgtggaagttctttttaaactgccaaatggtgtagaggtgtggttattcttgagggaaccagctgttcccagtgtcaggctctgctctttcatttttccctcgttcccttcctcatgttctgcttccttccattccctagtttatccctgcccctgcctaaagcccaccagggcatccatgggacttagctttctgtcccggaggtggctcaagcagggtggacatacctttctgaaattcttatctatgtcttaggaacttttacagtggagctgttgtgtattgatgcagcggactggatgtggctttcgaatagtgattgtctgcttttattttgtttactgcttaatctgctggggtcaagttaccgaaacttctacgtataaagacagtccttgcctgaatttccgagggaatcttgccccagaaatcaagcctttggttgcaacgggctgcctggctgccttcggcttccctctgtgttccagcctgactggcatatgcatacactgtttcctcatgttgcctcttgttattctttttaattgtcccttaatgtacgttttttttttcgtttaggcaatttgaaatagagcatgtgcagctctgcataataatatatgataggaaacatttcaaggaataaattattagaattgtttacatgcatggttcaaatttactggcaaattgcttaggcctcagttttatgatgtagctgccagctaggctccttcagggtgaaactctgaaataggagaagctgcccagcgctgtcccttcccagcacttcctctccttgttcctgccctttcaacacctccctcctttcccgcccccaaataactctgtggagctgccaggccttttgcaccttaatgtgaagacatttcgtgggtcctccccggacccgcccccagcaaaggtgaggtgcgcaaaggaataaatctccaatggtgtaattttagacactgtggcaactgggcagcgcggctatttttggccatggggctttctccttgacctgagatgatattgcctggctgctgccagtgcacccggccaaccctgcacgcggtccttttcgcaacgtgtttgccattcctgggggctggcttcttcctctttctgtcaagcagctctgtgctcatgcacgatgctgtgtgtttgagcaagggtgtgaagcggtcgacgcgtgcccacctaggcttgccccagggtgacactctcaggcagtggtcaggccacctctgaggggcaacgcagatggaacagacgtcctttcacattgggggtgggggaagatttccggtccagtttctgggtctccctcagcctccatacttgatcagctgctcagcgaccattctatgagtcactccttctctgggtaaggcgagccaggcagcctccaggccacagggttcatgcattcccgcccacactgcttcatttgaagccgcatcctcacagagattcttctgaccacccggcttgctgtcttcccactcaagctcctcatgcagctgctgtctacagaccccctggactgcctggggaagtgagtcggagctcctgcagcagaggggtggaacagctacacgaagatccgaaggtggccaaaaataacagcgctttccagatgagggtaatgttatagccaagatcatcgctggggtagggtgtcttgttctttgttttacaacctaaaaagtacacagaagactcaaagatcattcaggaaggaggaatcaagtcagtacagaacagagaaatgggagcagttaaaaacaaaggaattgagtttctttatgccaaaagagagaaaacagaggccttttatagatagagagagagccctggctatctggatggaagatctgttttctccagcttccatggccgcaaaagaaggggagaattctgaatttgcagagagagagagagagaaaaagtgagagagagagagagagagagagagaaaggatataaggagagactgaccaaggaacaaaagagcaaggagttagacaaaaagggagaaaaagatcaagagacaatgttgccgtctcttatctgctattggatgaaatttaatagaaacgtattgagaaccaactatatctaatccagttatctatttctgcatgacaaatcgccctgaaatttattaacttaaaatcacaaaaatcaagttatgatgatctgtcattgttttgagtgttgactgggatcagctgggtggttcccacacagtctttcttgaggataaagatgaggtctggcggaggccaaggctggagtcatcactgaggctgcctcactctcatgtctgctggttgatgttggccatggctgcgacctcagctggggctgtcaactggaacccctgcatggggtcactccatgtaatctgaacttcctcacggcatctcatccttgcacttctcacatggccactcaggactccaaagatgagtgtcccaagagagtaaggttgaggctgaatgattctttattttattttattttttttcttgagatggagtctcactctgtcgcccaggctggagtgcagtggcgtgatctcagctcactgcaacctccacctcccgggttcaagcgattctcttgcctcagcctccagagtagctgggattacaggcgcccgccaccacgcctggctaatttttgtgtttttagtagagaagcggtttcaacatgttgcccagtctggtctcgaactcctgacctcaagtgatctgcccgcctcggcctcccaaagtgctgtcattacaggtgtgagacactgcacccggcccaaattatcctttttgacctaccaagtgaccttttctattgtccaccaatcactaagatcagctcagattcaagggcagggcatttagatacctcctctggatgtggggagtgttaaagaactcatggacatgttttaaaactgctgaagtgtccaatcatggtgtcagctactcccagcctctcatctccaggagcttccaatctccaatctcgttgaagctatcaaagtcaattaagtattctgtgaaaagtaataaaataagtacccattcaccaggtgagtgaggtgatagaagaatgggtaccaagtgggatacaagatgaacactcgcattcgtgtaggtcacagacagagtgtacttcggaaggcctgtggccactgatcatttggagagcattgaaggcaaataggacagcagtggccaaggttcccttactctggagtgggggtgcttactcgccttattcaaacttctatgtctgtgctcaatgatttatttatcctcctctgccccgccttggtatgaccaattgtcctttatttcaattacatcattctgcaatggtccaaaaaccttgccttttttgttcttctgctgtgactttatcctttctgtgcatgaaaaagattcgggccaggtgcggtggtggctcacgcctgtaatcccagtactttgggaggccgagtcgggcgaatcacaaggtcgggagattcgagaccatcctggctaacatggtgaaatcccgttgctactaaaaatacaaaaaattatttgggtgttgtcatgggcacctgtaatgccagctcctcgggaggctgaggcaggagaatcgcctgaacccaggaggcagaggttgcagtgagctgagaccacgccactgcactccagcctggtgacagagcaataaatttaaaaaaaaaaaaaaaaaaaaaaaaagattcacctccccttctccttccctacatacttgctactccattgccagttttcagaccagtgaacttctctctgcccttgtctcattcctcagtcaactgcttgcaatatacatattcatcttgttttccttctttatggccactgtctcttgcctcctcaaatcctatcttatattccacgtgactcacgcccttctctgctctgacttgtcttatcccaggagccagttgtccagcacagtgtcatgggacagtgggccctggtgccacaatgcccggcatctccaccagatacagctttgagatcttcatgatgaagcttgctccaatccaagggctgtcaggtggggtttgcggttcagctgctaacctttctttggtaagcatttactatattccatcattgctgaaattacttttaatcttgatttgggcctttagtctcctaatagcacccacttgggacattctttgtttctgttttgttttgttttgagatggagtcttgctctgttgccccagttggagtgcagtggtgcattctcagcttattgcaacctctgccttccgggttcaagcgattcttgtgcctcagcctcctgagtagctgggattacaggcttgtgccatgacactgagctaatttttgtatttttagtggaaaaattttgtatttttctactaaatttttctacaaaaaattcttgtattattctactgaattctaaaaattttgtattttttctactaaaaatataaacatttttagtcatgttggccaagctggtctcaaactcctggcctcaagcggatgcctgccttggcctcccaacatgctgggatgacaggcatgagccactgtgcctggccaggggacattcatttttaattcccatgtaggctgggtctcttttatcctcttagtataaagtgatatatgtccactttagaaaatttagaacacagagacaagcaaaaataagaaaacaaatactgtagacagaaacattgttaacaacttgatgtgggcctttctcatcttttttctttctaattatggtttttatatccaaaaatgtagcatcaccacttagatggtcagtgcttccgtctgagctacttcctattttactgaaccagttctacagaattctattccctggccccagctgattggaacaggtgtggacatctggcccagctgggctagtccctgctctttccctgggattaaattagattgtatgcagcacattggcatatgtattagtctattctcatgctgctaataaagacatacccgagactgggtaatctgtcaaggaaagaggtttaatggactcacagttccatatggctggggaggcctcaattatggcagaaggtaaaggggaagcaaaggcatgtcttacatggcagcaggcaagagagtttgtgcaggggaagtcccctttataaaaccatcagaactcacgagacttattcactatcaggagaacagtatgggggagaccacccctatgattcaattgtctccacctggcccctcccttgacacatggggattattacaattcaaggtgagatttgggttgggacacagccaagccgtatcaacacgggattagaatttgtacctcgaaagctaaagctttagtggagaaggtggtttgcaagagatgagtagaggagacagtaagaagcagaggaagagatggcggagttctaggggcagagactccttgtatcctggcactgatccctgcagggaattttgtggaatcgccttgcatccttacctaatattcgtctttaatggagcagtgtctatgggattctgatattttcatctaacaatgcctgtgcagaatgacaggcacaggctttggtcactgaaaaatacatcatcgtttttttctgagtcatcatatgtcctcctagattataattttcatggctgcacagtgactattgtggatgtctcaatattgatgggagaagtgcaatttgcgggagaagcttgagctctggtgttaaagagtactgagttccaatgccctgccctgacattgttggctatgtgatttgggcaaattatttaaacaccctatgcctcagttccctcctctgtaagataggcacaacaataaggttaaatgatgtaatgattcttaaagttcacagcacattttctgtcatataagtgaggggtcagtagatttcacctctcattatttataatcatgaaaccagtattctgttactgctcatgtaacaacccttctattttccacatcctcccctgcctcctcctcctccttcttcttcttcytcytcttcttcttcytcttcctcttcctcttcctcttcctcttcctcttcctcttcttcttcttcttcttcttcttcttcttcttcttcttcttctccttctccttctccttcttctttttcttyttcttcttcttcttcttcttcttcttcttcttcttcttctttcatggagttttgctcttgttgcctaggctggagtgcaatggtgcgatctcagctcactgcaacctctgcctcctgggttcaagcaattctcctgcctcttttgtatttttagtagagatgaggtttcaccacattggtcaggctggtctcgaactcctaccctcgagtgatctgaccacctcagcctcccaaattgctgggattacgagcatgagacaccatacccggcctctattttcaacattataaacagaatggcagtgaacatccttacagtcaaatatttgcacatgattattctttgagaaaaatgccaagaagttgcattattggatcaaagattatggacataaaattttttaaaaaacatacactaggagccaggcttggtggctcatgcctgtaatcccagcactttgggaggccgaggcaggcagatcacaaggtcagcagtttgaatccagcctggccaagatggtgaaaccccatctctactaaaaatacaaaaattagctgggcttggtgactggcgcctgtaatcccagctactcaggaggctgaggcaggagaatcgctggaactcgggaggtggaggttgcagtgagccaagatcacaccactgcactccagattgagtgacagaacaagactgtgtctcaaaaacaaaacaaacaaacaaacaaaaaacatacagtaggatggctgtctctgaatcttcagtgttacccaccaccctagccttatccattgtcttcttggcctcagatttagagaaaacatgtttctttctgggtccaggatgtggtctatgttcactttccgacaaaattaaaacatcacatctgacatttgagttgagactctttgggtaaagttaattaattcatttaggtattcacttacttgtcaggtatagattaagtttatatatagcctagatttatggattagatttatattttgagagctggctggagtgttgccagtgatggagtggactttgcagccatcataggaagagttccagatggtcctgaggaagtcaaatgtagactaaggcttacagtatctgtaaaatcattcctttctagaaacggggacatttggaatatctttatcttttaatgtgcctggaatgacctgccatcagcagacccttccccggcttcaaggctctggaaaatatccacatgaaatttagtgagatgcttctttgagccacccactgtgctaggcaacttgggaagacaaaggtaaccctacatgatccttatcctcaagagcatcgtttgttggggaagtagatgtgcaaacaattagagggcaaagttaaatttgccagattggtggtgtgcacctgcaaggaaatcccagaataaggcattccatgagccaaggtctgcatgcagttagccacttggtccccggggggttttagttgttctaaagtcatagtatttgatttttctttttagttaccaacaatgaacactggagattttagataaaaatacagatttctgtcttaccttgaaaaaatgaaagaattgacaataattagcccctattccaccatggtaacagtgagggatggctgatcttttaaccagagaatgaaatgacttctcctgctgggcatggttcatgtctgtaatcccattacaggttcatgcctgcaatcccaacactttgggaggccaaggtgggcggatcacttgaggttaggagttcgaaaccagcctggccaaaatagtgaaaccctgtctctacttgaaatacaaaaattagtcaggtgtggtggcaggtgcctacaatcccagctactcaggaggctgaggcaggagaatcccttgaacctgggaagcagaagaggaagtggttgcagtgagccaagattgtgccactgcactccagcctgggtgacagaatgagactccatatcaaaaaaaaaaaaaaaaaaaaaagaaagaaataaatgagttctcctttttaactacagtccccactactccttacagttttatcctgtactgcttcatttatttatgctgtttgtgtgggccctgtgagtttaagaacatggcctagtggaaggaggctcttgttctttcacaggatatcagggaagatcagaaagatctgctagaggggagacctgcagggtaagcagaaatttgcaaagtagagaggaagaagggaggtggagcacctaaggcaggggcaacagcatgtgcagaggcatggggcttgggcacagaaggcctgcttggacaaagacaagctgacaaggatagcaagaaagttgagtatttaatggaagggatcaagagaaagaattggagaaatatgcaagtgccagctcacgagcagtctcgcataccgaaatagaggctttggattttgctctgtaaaaactagattcggcccggtgtggtggctcatgcctgtaatcctagcactttgggaggctaagtttggtggatcacttgaggtcaggagttcgagaccagcctggccaacatggcgaaaccccttctctactaaaaatacaaacattatctgagcatggtagcgggcacctgtagttccggctgcgagggaggctgaggcagaagaattgctttaatctgggaggcagaagttgcagtgagccgagatcgcgccactgcactccaacctgggcaacagagtgagactctgtctcaaacaaacaaacaaactggattggatgactgatcagataacagctaaaagagtttccaacagtgccccgactccatgctgatgctgtggaaagcacatggtgtgcagcagctcgtgaaatcctgactccaagcatataatacatgtgctgttacagaggcgaaaaagcagatcgagggagataggttaagtgacttctccaasgtcacaaccaataaacatcaaagcaggaagtgaaccccaagcttcattacagagcttgcaatctaatcatcggggcaccccacttcccagctggattagtgcttctgaacaactaccctggcagcaaagtcagggttgcatggagtgtgagtgtggggacactgagagagcaaagctgccgagctactggagacccctgcattggccagagagcaggagggccttcaccaaggtggcctagtgacgtgaagaggacggggtggatgggggagatgttgaacaggatacaggatggaccagcgggaccctccttcatggaacctgctggccatcgcatcgccttttcttttccttcttggaattctcggagcactctgggcgtctttcctagggtttgcttctgccatgtccccatccagttatgtgcatcttatcatatctagcatgttttgagttccttaagggcaggaggaattatgctttatttgccttaatattttttttagtttttacattgctgagcatagtgcttttgtaaatgaatgaattccaaaattatcttattcagatcatttctccttatgtctgcattttataagttagtggcaagttaaatgctttttcttttaaaatgtgaaaataatttccttacacaatctactttaaactacattaaaatatgagggaaagtaagactgggaagttgtttaaaaacagcaaaccctttaagagtcaatgtcacatttattgctataaaatatttttctctctctgttagacatctggttcccattacgtacagtattgggtacttgagttcaccagccatattgcataccaagcagtgtgcacgcaaaatccccaccgacatccacccgtatgcatttgcaccaggtaattctttacatttacagacaacccttctatcaccaacttaattcttaccaatacatttttgaagttactttgctcataggtatcttaagaccaaattgcctatatctgagaagtgaagaacttcaaaatcctggagtctttgctttatgtcattgtacaacccaactatctataatctggcattgaagtcaatgaaacatctaaatcttaagtctatattttctagtaacattgacccagaaatgagaaacacaatatggaatgtttgctaatgagtcatgaatttcattataattgcttccacattcaggatagctcccttaaaaccatctaatcttgacatatcctgcaacaatcccatgtgttgtaaatgattttgttttatttcttaggttactgctaagggcttattttctggttcatttcattttcttaaaaccacacacacatgtgcatgtgcacacacacattcagacatacacacctcacctcaatttctatttttttgaaataaaataattatgaaataaaaaggagccctaatcatttggtttgaaaataaaaataaacacatttagggaaaaagttgaaatacattccattttacagctctaattcaggtctctgagaattaaagccagaattaagcaatgcctaggcaagcagtagtctgtaccctttggagatttaagaacctatatcagaatggacagacacaactggcattcagtactgtaatgatggaaaattaaatacaactttaaaaaactgctcactttagaaagtgatctattagcgttgtacgacttcagcacttaaagtgactgattctaattgcaggatttggccagtagcaagcattaaagagctgcaggatcttgtattttatttcttttgggatattttaactggattttctctggaatgaagctttatccttgccacacaaaagatcgtgtggaagaaatttctctgttcgatggaacgagaggtaattatagtttcttcttctttgattcatgattcaatacgccagatcctaagaacattcttgcatttattctccccttcctttactaagtaaaactctatttttacagctcatggatattatcctgaaggactaaagatggatgcccttctctaatgagctttagcaagcagagaggcactcttttcctgcacctggttattttactttgtccttcagaatctctccgggataaaccggtgggtctgtaggatgaagctaccatgccataccttgagccgaacttattttacataggttatcacaaaactacagggacttctgggcaggtatacttcttagatgtacctactaatgagtttgcagtttccagaaaaagaaggaagcgtgtgggagaatgtcattcatctttgaatttgactttaggtttatgacatctacaggctatttcagaattttcatttgattgactacaggaaactaattaattgaataggattggaaactgcagctctttatgctaaaagagtgttttttttggggggggtgggggttgaacttacatgtttaagcagtttaagacatattgaaattttaccttaatctgccgtatggatttttttgttggtggctttcagatctctcaggtagtagaagaattgcctaccatgtttcagagtttagatgtgatcacctacattgttatccatgtaaccaacaatgggatcttgaacatgtaatttaaaactccagcgctactgtaaacgctagccttatttatttaaaacatcactctctgaaactgacattattttcttaataggayaacactgggtagaaagaagtttaaaggcactctctgacttcttggtgaatttttcactaacagttccccgttgctcataattgcatcctctcttccaaaacctagaatctgcagaagagagcagaaatacttgttattgacctgaattaggataaaaagaagagagaagataagatcatagctgttggcactttgtttatgaaaacatcatttcgaaaatatgcttgaatcaggcaaaagtaatgcatctccttcctctcctagcatattttaaatgccaacctagccagacaaaaagaatagtgccccaaattagggcattttctttcctgtatgctagtgtaatatatgataacatcatttaattattatttgtgacatttcaactacattttagatattatagaaatatatgcaaatatatgtaaaagtataaacataaaaatcagaaagtgtttaaaaattatcacattttattttgaaataatataggactcactgaagttgtaaaaataattcggagagatcccctgtacccttcacccggctttccccaaagacagcatttcacataaccacagcacattctaaacattaggaaattgattcaatattgttaactcagttagaggctttattcaggcttcagcagttttacatgcactcttttctggggtgtataataacatgtagaaatgcataaaacaccagcgttaagaaagcatctctcaccaatgaatattgatgatatgcaagattctcagacaatgtggttttacgcatcttgtgattgactaaaagagaagtagagctggttgcatttaggaaggtcctttatacctaattgctttakccatacgttaattaactaatcaattaatcaatccgaatcaagtgccaactatgagccagcctctttgataaagtggagatgcaaagatggaggcatggattatactcgcgaagaactcacaggaggagatagaaaatcaaatcaacaattacaacacgtagctgcataccataacacaaatgaaacacaccaatatgactaagcacctaaaagtgccctgcactgtatcaggcattaggcattaggtgaataagatgcatgctcttcctgttctgtggagctcactgctgagtgcaggagataagaccattaatgagcgatgacagcaacgtgctctaacagggagctgtggttcggcgtgggtgggtcctaaccagatcagtgggtctaggaaagtgactcaggagtgtgtcatgaggtcaaggccagcatctcaagacgctcagcatgactactttatgggttctttgaaccaatctctgactatttttcatgcagaccccgtaaagcatcttctagttgtgctatcgcatttgagcagatggcttgccgtcacgagagcagtcaatgtttctcagaactgattcaaaagctctttgaaggccggacgtggtggctaatgcctgtaatatcagcactttgggaggcctaggtgggaggatggcttgagctcaggagtttgagaccagcctgggtgacacggcgaaaccccctctctacaaaaaatacaaaaattagctgggcatggtggcatgcacctgtggtcccagctactcgggaagctgaggtgggaggatcagttgagcccagggggtaaaggctgcagtgaccactgcactccagcctgggtgacagagtgagcctctgtctcaaaaaaaaaaaagcyctttgatatcatacctggtgtcagatcttctccattcaatgctggcaggcctggtgttgggctcacataagacatggggtgaagaggggtttgctttcccccagtgaaggtgaagtgttttcctagagcatggttggttagttggtgttggaaaaatataacagttgtatttttctttcctaacaaattgaggtttcttattcaaaatgagacaacactatcaccctctaagctgctgtgggtcttatcatcggcctttcctgcttagaacccctcaattgctttacactagacttaaggtggcatccaaaattcctacctaagcatgtggtctacaaggccctctgtgatgtggctctgctcacctatgtctcatcacgttctgctttatctccaggtcctagtggtccaagcatgctggcctgtttattatttctttaacttccaagctgtttcctactcctggacctttccacatgtttttggaaatgttttcatttttcctgatacttttatctataacctcattcttcaggcttctattgcaagaccttstatgctgaagcacttgtttatatgaaggcttcactgtaagttccactttattcttacttttactttgtgtatttattattgtatgcaattttctattcattggtgcgattatataatatttatctctcccattaaactgtaagttccatgagggccagaatgatgtcatttttatgattatctcctgaaggctcaataagcatttgttgaatgaattattgaatcaatgaaaacatgaataaatgaaagaaatagtgacatatgcccttatttcttctatgtttaggtaatgctacacctgagatttggaagtatctatagagtgttttgggatcatttctggagttatttctttctcaagttcaggcagcaatcattttgcataaaaatcatggctgggctgagtgtggtggctcatrcttgtaatcccagcaatttgggaggccgaggtgggcggatcacctggggattgtgagaccagcctgaccaacatggagaaaacccgtctctactaaaaatacaaaattagaaattagccgggtgtggtggcacatgcctataatcccagctacttgggaggctgaggcaggtgaggcaggaaaattgcttgaacccaggaggtggaggttgcagtgaacccagatagcgccattgcactccagcctgggggacaagagcaaaactccgtctcaaaaaaaaaaaaaaaaaaaaattcatggccgacatgattctgtgtacttcagtggtttctgctctaggtgttttattggtgaagttgtcatctcaaggctactccaacaatgggcaaaccgtaggttagatgcccactgctgactgaaatggtggccattactttgcaaagaatagcctagagctgctttgctaatcccggggctctgaacgtggctctttggtacacagagggtcttgagcatgggaggtaccttggcagacaggtctagcacacagtttaaaatgtttatatctgctgaattctagatccaaatcctgtcttcactggcttcaagaatcctgtcttcactggcttcaaaactgggatgaaggaggctccttagtggagagcaaagcaaagaggtatttgacacagggataaagggattgatagaagtcagggactgtctccagggagaagtgatctttgagctgaatctagattggtggtcaggattgagttactcagatggacatacgtgacatggtttaagagtgggctgagggaatagcagtgcaaaggcctgaagagatgtttagtgaaaaggctcaaccaaatctctggacatacaaaaccaactaatggactgtgagaagagtggtaatcccccagccctcgaatttcaattatgtagataattgcttcaattttgtgcctggtatgtacccagtctaagcatatgtttataatctaacgtagattacttaaatgttgtttggtaggtaataatgcagtgtgaatttcagttttttgtttgtttgtttgtttatttgagacacagtctccctctgtcaccccccaggctggagtgcaatggcacgatctcggctcactataacctccacctcccaggttcaagcgattctcctgcctcagcctctcgagtagctgggattacaggcatgtgccaccatgcccagctaatttttgtattttttggtagagacagggttttaccaccttggccaggctggtctcgaactcctgacctcatgatccacccgccttggcctcccaaagtgctgggattacaggggtgaaccaccgtgcccagcagcagtgtgaatttcattaccttttttcctgggtgtttttatcaagaagggcttgtgtgtgtgcgcacatatgtgtctttaaactcatttgttaatcttgcccatgtataaataaagatcacagatcttgtttatgttaagagctgtgagattttggtgagctgctgcttctggaatgtatacctagtgaagaggcagcattgcgtaccagaaagagctcacgttttggagttaaagacctggggacaaggatcaacttggcacttactaacctgtgactctgggcaagttgcataacctctctgagtcataatttctcccccactaactttgtggtaataataaggttatttggctcatttatctcatagaattatttatataaggcaatctatctgaaaaaactttaaacattataaagcaccttgtaaataggaggcatttttattctagaaaaagtgtacttaaaaatatgacaggttatgtaagtgaatggagaggccctacccaagctcaatatcatttgaaaattgaaaatagcatatttcaaatatggcaatatggctagacattcaaaagtttctgagagcagtgaaaatttacacttattgtgttgcaggcttatagtttagaaggcagttcaatgttgtacaaattaaagagaaagtcaaccccccaaataaagattgataaaaacttttgatttttagaaaagaaggcataaagcaaattttcatgaaatatttcttggtaactcactttgcagtatttttggaaattatgtgacaatagaattactttccagaaaatagtaacaaactttccccaaaatgttttatttaatcaagaaggagctacgtaactggaggaaaggcaagcacattttatatgtgacaaacaactatctcacatattaatttcaaaatgtaagacatctaaaagtgcacatcaaactcagcattaaaaattattgagatcctttgccgtaaaartgatttccttatattttctagaaactcaaattggatycatattaaagaagagaaggatggatttgtttagacaacacaaacctaggaagggtttgagaggtgaaacaaactgggttatggatgaacgggggcaattggaatgtagaattgaagcagtaattaacatcttggtaagttacccaccataaaacgctttagagcaagatagatttttgtttttcttttttttttcttctatttcttcttttctattttttttctatcttctcatgtaggacaccctttttttttctctaattttgagatcctcatggatgaaaacaaaacatatattgaaatattgcataggaagaacacaaatagctttgataatgcaccaactgcaagtggattcattggctctgtgtcagctggtgcatgtaggaagctgaagaatattttcttgccaacgttttggcaagacttattttttcccggggggtgggcgcaagggtgcaatccaataataattwaaaaaaagactgtataaccattgtgtaggaagagcttcagccaccctacagccgagagygagttggtcytccacaagtcactgggggagatgaagggtacactgtagtcaggtggagtctctttgggcctaaaatcactataggacacttttccaaagtaccctggtgtcttcagtgatcctgagtgctggcacttgcactttgtcactacatccatcccagagctgccccagtggctggaggcctcttgaatatcagcatcatgctctcccccaacctaggggattcgttttcctcccctgcagtagacatttgcgtgaaggttaatccacagttaggagttgcttaactcaagcctcagaaagcgtacactgcatctttaagaaatagtttacttgtgaatcagtaaacgtactagacaaagcagccattacttatgcattcctgcatatccagcaaggtgaaaataatagaataaacatcatatacttcattatgatatcggtttacacttccagggtacacaaaaagaggccatttcatcaagctaattgcctgaaagtaaaagagagagaactttagctattagtctattatggggcttttttcttaatcacaaataggggccgtgtgtccctggggggatgtgtattctaatttacaattgaactacagatcagagcaatcaatcttgggcagcacttttacagtgtaattgctgcaacataacaaataaaaaaaaaaaagagagagagagagagaagaagaagaagaagacctaagctgagcgtcagcttgaggtggagatatctgcaggcactagttcagggtgggagggaagaaacgccacaaacatgaatatgcaatgagggctcattagcggcctcgtgttgccatgacgaatggcattatccgcggcctggtgctgcctaaacgtgaattttataacgacccatttatcatgacttgtcatgggcttctgtactgtactttcttccagctcacacacctttccctattatgacagtagaaatctttccttttattattattgtttccttttgtattgatttctggctcttcaaaataagttgcatcaaacagagcaacatgctaatgagcgatttgtgccttcaaagttgaagaactaaaacttgattattcatcccgtyttctctatagtcatataattgagcaaacagttgggctaaactttgaaagaaatttcttgatgtgtgagtttttgtttttgttttttgactgtagcatcttgacactgcagattttttttaaagttaaaattaatgaagtgatcttcctttcatttattttattccctttgttgtacttccagaatcttttaatatcttaaacgcacagctcaaaagtttctatgtctcttcccaaaatctcggcaccattacagaaaagtgtaagactaaagtgtttcagagatttttagtgcttagcattttacaagtgcttgagttgatttctcacttagaaaccctcttatactgtgcagaggaatgttagcaaaaagcttgttctttgatgataacttcctaggatgtacattttactaacagaaaaaaaaagtggaagcaatctcccatgatggaaaccatgagatctgtttgaatattcagcagcaacaatttgctctatgcaaaggcttgagtctttgccattggccaggagggaggagggtgcatttgtctgtcaaaattaagtccaccagtcagccaagcatagggtcctagattggcagaagtgtcctattgtaatcagagatacagtatgccttatgattagtccgtttagtaccatgaaaagggtagcactcaaactatttctcggatttagcgtggtgaaacacggcagcacaaggaagtagaatctggtattgctttgcacatccagggattatagtcattcctgtatttaatttgtaaatggtaaatagctgaccaggtcttgttagcatgactgtctctactgtgccctcttggatttcattttaatagtaatgacacttttacacagtaatactattcatgtaataatgatatgtaaaactcaaaatagtccgtgtattactgataattttatattcataaaggattttgccctccccaggttcttgtttttagatccttgggttcactagaatcaggtctattatttaattttttttttttttaaggaagagaaaattggggctcagacgttaagtgactggctcaaggtcacacagaaaaatgagatgctggggctcagcatcaagttcttaagtccctgggtcagtgctttaaggtacccaaagttgcaaagcagaaattattcttaaaatggcgggtaatctcttttaggatttaatgataagtgaatgaattgggaaaggatcccattgaaaagatgaccatcatttacacttgagagcctgttattctccaaagctacctactaggactgaaattcgcatgtgcatgtcaattaaaattaagtttccattccaaccatttaaggtgaattaactttcatcatttaaaaatgcagatatgaaatgtttttcaacatagagacttgggcaccatcctggatggtaatctggtcttatgaatccactgggcattatatttttgtttctgaagaaaatatccttgttttcctcgtgaatgcattacataggatttttagagatcattttgtgaagaagggagtgaaatattggcaaatgatattaaataacgctgtgattgtgactgaacagattaagactttgtctatacgacaccaaacatctggatgaaaatggaaaaaagaaaagtaaaaatccttgatgttctgtttacttgataccatacatctggatctttaataacatctggatttttgactcttttctcctcctaggtttcatctgggtgtttggcatcatgttcagaaatgygaaaaataaaattcagcaccgttattactgaattagataaaatgattgtatttaattaatccgtaaatattaastaattattctgtttacmataacatgtaatgaatataattctccaccaggcaaataaagaaagaaagatgtaattaggtgatttaagcataaaacttggctgaaagcatatttaaatcttggtcatagtttactggcattaatttccttgggcaaaaatctttgtaggtcctcagacaaccattttctcttctgaggaatagatttccctcgttcttctgagggtctgttcatttacaatgtgttttgacagtagtaaaatttagtaaacattcagtaacatatgagatacatctagtaatagatgttttctttgccaagtgaattatctggggctgataaaaatcagtgtaaaacccactctcagagcagccttctgacatgcctgaggctgaaccccgaagaggaatctactgaaactggacttgaaagcctttgtcacaatgaaaagcaccttctgtgactgacattcttttgtgatctcctccaaaaaagttatcataattattgaacatttcctctgtagcttattctcaatccaatcagttataatgaaaatagtctgcttgctttttatattcttaagttttcaaaatgattagtgcttccttgagatatcccattaattggacacacaacccagatgaaaaggctgaaacccaagagtatataaaaaaacataaggttgttgcaatttaagtgccttcaaaagrtctaatttgatttctaaaagcaattttgcagatgtgaaaattaaaggcacgcagaaacaagatatgatttaatgaacgtgtaggttaagaaacatttagaggtttcagtagctttactctgacgtttttgtttgtttgtttagctgttatgttggaaagattgagtccacaacacaataaaaattactgaattttatgggtcgctatttccttgatcaaattgtcccattcttcccaacatgtttctgaagcaactttgtatttctgtctgcagattttcaggtccaggacccgtcaatcaaatttcagattctaataaagtccaagggtctctccacttaggtttgtcttagctgtttcatcaatgagcccctccccctttcccagcaaattgcacacttattcccacttaaaaaaaaaaaagagagagagagagagacagaaaaataacccttcccactggttctaatgacatcttcagtcattaatgagttaataaaaatctcgaagtcatctgggctagataagaaagaagaaagaaatgtattgtactgtaatgacaggctctcgagctgccctctgagatgtcatgggtcagtcatgttaagaatgtgtgcgtccaatcatctgctgatttttatcagcaagctctccagcaggagctgacaagggccagtttgggagtcacaatgaataaacaatgactttttggattgttgggggctgtgtaatagagtgaggggtttatatatactaaaacatgatgacattagcaatcaatataccaattactggacaagttattggaggaggcattcacgtgtcttcagcctgcttgcactttgaaggggcctctagcagggagagtccgtgtgcccagaggccggcaaaggttcaagacgtcaggcccagatctaaaaggcaagcccctcttctcaggctgaagtagtccagagctggatgatttgaatcccctggggagtttattaaaaatacagattcctgactttccttcttagagagtccatctcaggagtctggggctaagggtgagacttagtgtttttaacaaagtttccaggtaatcctgatcgggagcattagggaactgctgtacagttgtaattcccaaagtgctgtcccccagccagagcagctgcatccctatcacctgggagcctgttgcaaatgcacattcttgggcccctccctaaacccactgaaactgaaactcactaggggtggggcctagagatctgtgttttaacacagccctcaggtgattctgatgcactgtacagtttgagaaccaaggctgtagtacaaagatccttgccaaggtgttgcaacacagctctgtcacctgtagcctctgaggctcctcatgggtaatttgttacttgtactagttagagtgctggagtttgcaaatgatttacttaaaaaaattaaattagagtagatccaagattatcttcacagtcatgccactctcattcacttgcatactgctaggctttcttgaatgatcttgatgtatgagtgactttggttatagaataggaagaataaacatagcttttgtctattatttgaagtggaaagagagagtggatttgtacataatcttaaaagaaaaggagtccataagaaaaatcaatgtacgtgaagcatttatttgatgtatgacaaatatttatgtaggtaaccagtgccacttgtgaaacccatgggcaattggtgaggtctactgttttcgtctttggtagccacagaacatgcaacgtgtcttaattagaagaagagaatatgcacggcccaaggtcagcatatcctcagaagaggaatggcgaagaccttcttgcagttgggttgagacttcctttattcagccaagggtcctcctaaaggggcttgctcagctttcaaaagaggtggactcgtttgtcagccatgcagtagatttaaatcagtgttctccagaasacgtttgaaatagtaatttcatgtctcaaaacattgatttaaaaaaatgtccggggtcaagtgagaaacagtagattaacctgagttaaatatgattgtttgcagcagggcccccaaagcctccagcacattactatgcactgtgaatccccaggacatttgatcttcaatagatctgattacccaaaccgttttataaaggataagmttgtagcattggtgttcaaggaatagactttcaggagacacagattcctattttctaagatggcaacaacctgttggtagaagctagttcttttatatattgtatagtaaggaacctcttcctttattctaatgtatcaaaccctctgtgtctggygtcaggattcattatgtggtggcttgacgccagcaaaaaggttcatgtaacactcaccaaagagttaaataagttgtccagttgttgatggtttggttaaattatccctgaatttttggcatatctcccagaacaggtactcataaaaaaagaaagaaacctgggttttgctaagtgagattacattgtgttttcatatatgagggataattccagtgcaatacttgcctrtacccagaaactggctgcataagcagacgggcattgggctgggtctgatgttagaaagtacttctgccccctccattgacagtacttcccccgtcttttctagctcacggggctccagatggccatagctgtggtagycatctttgtccccgtactggctatttctgaaggtgaaaggttggggatatgtattacagagggcaggtcaggaaggatttaagcacattactggttgtaaaatttcttttcttgaagttatggccagaactgtgcgttcgttaatgccaaatgttaattcttgctgaggacatgatgtcttataaatgttgtaaaagaatatcatttttcctgtagcagggcaggtacttttaaggccatgttaagaaaagggctagtttccccatagcatctgcaggtcacctgcttgcttataaatcgtctctatgctaacatcccttccaactgttacacaatagttagaagaaattgtcacatggtagaaagaatagaacttagctgacatttgaaagacgtgtaaagattaaaaacaagcaaacaaaaattcctccaaaataaaacaaccccaccacccttgttaatatttgtcaccttttctacatagttttacaagtctctgctagactcagaactcattaggatgtgtctctcaactaaaagtaatagagcaggttcaactttgggaggtcctaaagcccttttttcatctcctttgtaaatatatccccattgacaccacatgtgcttccaagctttccagacataaggcgtttgtataatgggattcactctacaccctcgtagaaaagagcagaagttcaacacagttaacggagatctacccaccactggtctggtttgttatgtagttgaatatttctcccctttatattctttgaaatgttttgaattaaaatagcttactcaaggtcactgaaggcatatggtcctgctcaaaactttaaacaaaacattagtttttacaaccttttgtaatttggtattgtatacaacatagctatatgcggagtttctgtaatcttttcagtgggtgacagaaatatgagaagcaaatttataagccatttagtgaagcatttaatcaatttcatgcatagaaaataactccgattgctttgctttatcaatctttctttccagcaaaactcttaagtcaacagcatctccaaacactgcctgggtgggggaggggctgggggcggggtggagagcgggcaggcacctttccctgcacacaaatgtcagggacttcaaaagtctgcctaaaagggcttgccagcatctatgaggcttctggaggctgttaatgtatttcagaaagaaagcacgggtctaatgtttagagtaagttttcaaggccttttactgtaaagttattcattaaacacccttttcccagagtgactctcacatgctcagcagtgcagactgtgttcaacattaggctcaaagaagtatttttgtaaaaactgtttcagtggttatgacttttaaatacatgaaaactgaaatgactcacattaaaacttaacttctgaattaaggagttgaagcaatgcgaccaaaatacctgagattcaccaaacagagctattttagcagttttcaggatacttgaactgttttttagagttcatgttccaattctctttttgaattgcttggaagattaatccatctcttggctacatagtgagttaatattttcttttctgtcatgtgctagaatgtctcttacgacattttaccccaaacaccatcaagtttttaagtgaaaaagtcctaagggagcaaaagatgattttgccaataatcattaactgctaaactgtattaaaactgcattagctctaccttgtcctctaaatgggaactgatatgaaagtattgcagatatactttctaatttagaaaataatttgctaccactgatttttgaacctagaaaaatattccagtgaataaactccagtctagattcctcttttttttttttttttttgagatggagtctcactctgtagcccaggctggagtgcagtggcatgatcttggctcactgcaacctccgcctcccgggttcaagcaattctcctgcctcagcctcccgagtactggaactacaggcgcacaccaccacacccggctaatttttgtatttttagtagagacggggtttcaccatcttggccaggctggttttgaactcctgacttcgtgatccacccgccctggcctcctaaaatgctggggttacaggcgtgagccaccgcacctggcctacattcttcagttctgattttaaatcggctccattcctggacctcatctcagcctcctgatgtttcactctgccttttaaatatgacatatgcaagtatttgcctgtgttggcagtttggtggcatgccattgatgtttattttgctacactacctaacttgtgggggccccatcattttattgaacagagtcgccttaataatcttgcataaaattggcagctcttggggaaactggctatgcaagtagcttggctgatttgtctatctctctgtctctctgtctctctatctctctatgtatttatcattctttctattgttattcaaccattaagtcttgcattacaccagtgcctcactgacttttaaatgatcattttgaaagaaagatgtctttggtgtaagatctgatatttaatgcgaaaagggactccttagaactaaggagtttaaaattttcaaataaattttggaacaccaaacaattaccatatacttattctacttgtaaatattaaggtattagaggataaggctaaagtgctctttgctatgacttctctgcctcccttgatgtgatctatgttaccaaggatgtgcatcttgccagtyccttttctgtccaaatgagtcaccawaatgtgctatatcgtatgtatcattgcgcatttgttattttcacttatccatgtcttggagatcttacctggttaggagaaacaggtataccccattctttctaactgcttagagaatttcccgtgatgcaggtagaccatgctctctgagtttttctcctatgatgtgtgtgtagattccttctaccttttctctattacaaatagcactttagtaaatatccyggtacatacttcctatgtactctagtatttctcatatgctcatatgcataatacaatactyatatgccatgagtacttctctagtatgggcacttaaagtgaaactgctgggtcataagtatacatattttatgttttactagttactgccacattatccagcaattttaattttaaatgaaagtcctaccctaatctctgatacagcttttctcaactctactgaaacctacacattgctacagccagtctcattctctgttaataattttgcttctgcttctccaagaagatggaaaccacccagaatgccttttctactgagctttcccttttctagggcaagctggggccaggcaggctaatcatgggggcatagccagatgttcagaaacggggctgctcagggccattgaggtgaccagacattcagaaactggggagcatcaggtcaacaaamgaagcctgttcatcttttaaaaatgcatcaacaaagtcagtgacacattttcattttgatcataacgttgatgtccaaattcaaacaattgcctctgacagttttatagctgaggcctacacatttttactattttcaaagacagccttgggggcaaggtagaaagacttataatcagacttgtggtgtttgttaggatttagggcccgggaaggggatgctcctgggaacaactttccttatccccttcactcagtgtttttcttgtcctctgtcttagaggacatgtcttagacccatgacctccttcccagacttattgctgcctcttcattcagactcacctttaaatcgttctagtggcttcatgttaatttgtctctgctagtctcctctttcttccatccattttaccctgctaaatcttcaagaagtacaaatacggtttttagtttttttgtttgtttattttcaagagacagtgtctccctcagttacccaggctggagtgcagtggcacaatcatagctcactgcagccttgaactcctgggctctagtgatctcccacctcagcctccagagtagctagtaccacaggcatgcaccaccaggcccagctaactattttttattttttgtggatatggggtctcaccatgttgcccaggctggtctccagttcctgggatcaatccatcctcccaccttggcctcccaaagtgctgagattgcragcacgaaccatccttcctggccccaatctggttttgattggctattgtttaacatagcttcttactactcatgccctttatgctgccattcaaagtcctccatgattttttcccaaacttgtcttttaaaacttcctttcttcttctcctttatgtatattttacttagcaaaacaacatggttacccttccctcaactttcctgcctcttcactcttcccttggccagaatgctctttcctcaactgcagagaaatctgcatcttcaaagtcaggccactccatgaggcttttcctgtcttcctcattttctaccaaatgagtctgactgttaatagaagacaacgacagggattaaaacgggtgcagtggttcacgcctgtaatcccagcaccttgggaggccaaggcaggtggatcacctgaggtcgggagtttgagactagcctgaccaatatggagaaaccccatctctactaaaaatacaaaattagctgggcgtggtggcatatgcctataatcccagctactcaggagactrgggcaagagaatcatttgaacccgggaggcggaggttgtggtgagccaagatcgcgccattgcactccaacctgggcaacaaaagtgaaactgtgtctcaaaaacaaaaacaaaaaaaaaattggagaggraaaccagaagtcagaggttgggctaacctctaagtcctaagtgaaatggctcaacctggtataacctaaataagggttacacacattctaagtgatggatgtattttccactccacagtctaaaacagaatgtgagaatgtaatctagttgtagctgtattaaaatgttatgctacagttaagtctctgttcagctcctactstagtgcaggcatctaatcaggaaatggcctcctgtataacccatggattgtttgtaactcaggaccctaagtgcaacgaagctaaccctatatatattaataacatatttagactatgttatgtataccaattcagagatgaaaatgatactttgagtctattagtagaacatgtagtttcagctgatttttaagataaaaaggatctgttttatacagttttctctacccttttctgcctgttccccctgtaagtaatggtatacatttatgagaagcctagtggaacttagccatggaatcctggtcttgcacgagctttttctttttttctttaaggataactgtcaaatattgggattgaatctctaaaattagcttctagaatttatgtgttataatgaaaaattggaagccaactatatgtccaagaatagtagattgagtccatacatataacatatcaatrttgaaatattatatgggctttaaaatgttataaagtcgtattaatatttaaaaaggttttagggtaatcgtaaggacaggtaaaaggcaaacccatatttaaacttaactttatatggactgtgaacttgtcagggtgatagattgagaagttattttatttctttaaaaaaattttaaaaatgtgggcaaggtgcattggctcatgcctgtaatcccagaactttgggaggctgagggaggtggatcacttgaggtcaggggttcaagaccagcctggctaacatggcaaaacctcatctctactaaaactacaaaaattagctgggtgtgatggcacgtgcctgtagtcccagctactccagaggctgaggcaggagaattgcttgaacccagaaagcagaggttgcagtcaaccgagattgtgccactgcactccagtttgggtgacaaagtgagactccatctcaaaaaacaaacaaacaaacaaacaaacaaagttaatgttatattgagtggacattgaatttcaagcattacagtagctgtattactcctagctgagtggtgagagctggatcagagaaagaggattctgtcttttcctagcctcagaaaggcagctggaggggttcccccaaaactagggaagagcacacattgctgttgcaaacaaggaacttgagatgggcaaacttaaaaaccaccctgatttcacttgaagagactggtttaaacaaacactttttttttttttttttttttgagacgaagttttgctcttgttgcccaggctgaagtacgatggcgcgatctcggctcaccacaacctccacctcccaggttcaagcgattctcctgcctcagccttcccaagcagctgggattacaggcatgcgccaccatgcccggctaattttgtatttttagtaaagacggggtttctccatgttggtcagactggtcttgaacgtctgacctcagttgatccacccaccttggcctcccaaagtgctgggattacaggcgtgaaccaccgcgcccagccttaaacaaacacttataagagaaacctgaagcctcagtataagggtagaactcatcatagctattcctgctactaaaaacacacccagatatcctgattttttatagattgattatcttatgagaggacraagaaaactagccaatgggattgccaatgcaccttactagtctttgaggaattgtaaaaaatggaagaattagtggaaatttagagacatgcaaatgaggtttttactttaaaaaaatattctgaaggtgaattttggaaatgaaacacttgatggcccatgaattagttgttgagcttcaacagaatttaggatacatttttaattggatatttggtaaacctttatcagacgatgatggaaatctagaacattagactgagaaggaagttggaaatagaaacagttcgcttagatccctcatggattcactaaaaacagctcaagtcatgctgacttatttttttttttttctgataaggtgaatgtgtggtaggaagggatgccataagccagcaaactgtagtctcttcaaactgtaaagtcaagaggaaatcaccaggggatcttgttatttaaccaaatgcagattctgagtcagtagatctggggttgggttttagtttctgcatccttaagagactcccaggtgacactgatgctgcaggctcatgggctgtactttgaatagcaagattttagaccatgggcccctaatacagcttkctaaaaaccagatttatgccctctatgtccaaagtgtctgattccataggtacaagactctgcttttttccaggtgtccaaggtaattgtattgcatgatctcataaggaaccatagcatcagacactacataaccagtcacaatgcacaatatcattatagttcttttttattattttttttaatacagagtctcgctctgtcacccgtgctggagtgcagtggtgtgatgtcagctcactcattataacctctgactcccacattcaagcgattctcctgcctcagcctcctgagtagctggaactacaggcacccaccaccacacctgcctaatttttgcattttttaagtcgagtcagggtttcaccatgaccaggctggtctcgaactcctgacatcaagtgatctgcttgccttggcctcccaaagtgctgggattacaggtatgagccaccgcgcccaaccaatatcattatagtttttacagtcagttgtatttataattggttggacctttttttttattctagataaaattaattacttctaccatggtagaacttctttaccgtgtacattattgcatattttatgttctgtccttgcacaccttggctcgcaataaccatgccctcttaccaacacacgcttaatagaatttgtatgcacagttacattttttttggaaaggaattgagcattgacttgttctacatccctaagcctcaggctctcctatgatcagtgaacacgataatacctgctttattggggatcagataagaataatgtgaaagaatctccaaggactgaccttgtaaatcagtaactctgggttctaggctcttccctgccaaatttgacatgatctcagacaagttgtcagatgtctctgatcttccctcttccaccagtagcaacagagtttttaaatgtataaagtgctaaacaaacttgagagagttttattgtgagcagtaggaaaatgcattactttttaatttaatgaaatgaatatccaaaattaattgaacagcattgaattaattaatatatcgttaatttctacatgaattctctccattagcagtgtgtcttataaatgtttgctagaggagtcttatatgtaagcattactcactggtagaagattctcgcctaatacatatgctaaatttccatcttcttgcacgattctggttraggatcgtattattccagccttagttgtccccgaggtatgcaggaatttctctcttttgtgttgtgcaacccattgtgaaatcacagtgccatcagcgctgctatctgtgtgttgctagaagtataattttctatacctgtttgtctttggccagagaaagaaaccaataattgcatgttgaccttgcttgctgcttcttgggccaccatatcccactggactgtgaaatcagcatttctgcgatgcctatcttatttgtgccattctttgcctgaacattctttcctatggtgaatttcagaaagaagaaatacagataactattttttaaaagttaactgacctaaatgaagacctagactgaaggaagtccagctgcctacttttaaatataaattcacaatgacccagattaatagacctttgagccagaaaaaggttgaaaatggtgaaggcaactgagatacggtaggtgaagaataggggctctggagccacatggcccgggctcttattcagcttcactgccttctgtgtgggtaatctctggttacttagttcactttgctaagcttcagcttccttctctktgcaaagaggatttaagaaggtaatcaattctgctagaatctatacctggcagaaagagagtttagttttccctcccaaagcactacaaatgcttagaaaagtccccagcacagaataggtgctcagttgatgtttgttgaatgaatagctttcttccrgaatgatagaaaatacgtgtcttccttaaggtcctgcaaaatgtttctccacatgccttctctccgagcactccttcactggaatgtttttattgttctttaacagtgaatggccccagcattttgtttatcatgccagagataaaccagggcaccattaaaagtctaaacccttccatggacttcyacatcatctaaagtgtttattgacttgaactaaagtagatgcaacaatttgaagcttcaaccaagtttagtctttttttctttttttactgtttacaaaacaagatattttatggaagtaatttatacattgaatagaagagggctattcccaacattatctttatcttgtagacataaataacaaacaactccggtaatcaaaatttactacaattgtaatagattttggcagagtttatgtattgtatgcaatgctaacataacgctgagtttcaaggatagaggccaggattcctagttyggctttgttaaatgggaaaaaaaaaatyactactgtattcstagtgtttactacatttaagagattaattctcataaataaaattgtttataccagcttctaatcagaaagttgaaattatctgtggcaatgtagcccactaaaaacttgtatactatgaaaatatttcaataattaatgcatgctccatctagagkaatcgacagtgaggtcataaacgtaatgggccatctgtgtttgatttgtacrtgaaaatgcttaaagagatatgcaggtaattcaagcttccctggcaaggaagatttgctccaacttctccaagtagcagtgccatttattagattttctttcttttttcttaaagttttttccaggtttttatttgatctaygtacttctcactgtttcttgttctaatgcaacaatcccttttagagtttttggtactctaaaaccaaattaaattggctcatgttcattcttaacaattatacttggttcccctaatwtttttttttttttttttgagaccagggtctcactctgaaacccacaatggagtgcagtggcacaatcacgctaagtgcagcctcaatctctcaggctcaagtgaacctcctacctcagcctcccaagtagctgggactacaggcgtgagccaccatgcatagctaattttttagttttttgtagagacagagtcttgccatgttgcccaggctgatcacaaacccttgtgctcaagcaaccctcccacctcagcctcccaaggtgctggaattacaggcatgcaccaccacgccctgcctcctaatcatttcaatggcaacttgaaagccacatgtcttattacaatattagaggctcactccagtgactaattcttctctgtctgaccacttcaaactttattattgcagtttttgcttttttgtcggttaacaattaaccagccctgcttatatgtgttaacgaagagtgataggaccattaagaatcttagtcatggttttgtaactcacccccgccagcatggagcagaatctcttatttctggaggcaagacaacctcggtcaacatcaaaggargttctaggattttctatggaagaaaaccaaagagcattgaataatagctgagacctggacccaaaactgtgtcgaggaacacacattcgactagaatttaccaggatttatcatctgctgtgtgctgtgctaggcactgaggacatagtgaatgaaaccaacaaggtccccattctcatggttcttatatgctagtaaatgtgacttcctccttagaggtactcttaagttctacaactaggaaagtaaatggattatctcccttggtagacccccccagatctgtatctcctcctgtattgcctgtttggggaaaataagccaccatctacccagtcactcaatgcaagaccctagggtcatcttggacgattctcttcctctttcctctccatcaaggcgattcacaagttctgccagcgctgtttatcatcgcctgactctgcttccttctctttatccctasctgtacagccacagtcttaattcagttcctaaaaatttttttgcctagaatcttgcaacagcgtccagtattaattccttaccattctattctccatactgctgctatagtgatattttaaacattattatgttaataagattatgtcatttctctgtagagagtccttactgtaagagttctacaattgtcttggagacaaaacccagacttttaacatggtgtacaagaaaaacttttgctaatgtggcctgggcctgcttcyactatgccatctctccacaaatccagctctctagtcctgcagaagtctatttgccaggcacattataccttagtgcctttgaccatgcaattccccttgcctggaatcgctgactttcttttattcacttgcacaatctctcttcacttgtaaaagctactcctagagatgttgctctttctgcacagcttctcttccttgatgcttgcctgggttatgtggacacttctcagaacactttggktccagctctgtggcagcatggtgcagctctgtttacctgccccaggtggtcagtcacacagtgcctgcatacatatgggaagtatgctgaataggaggtgttgaaggacattcactacgtgtccagcactgtgttatgtgtgatcaaaggcatgatagaatctaaaggcaattctcaagagtccttgtctttaagtgggatggcaacaagatgtctaccctctaccaatctgttatttatttggaactaattgttaaatcacccttattctccacttttccaggctaatatttctttaaagtttttagcttttaaagtaattcttaatattcggttctgtcagttcttacaattcttacttacaaacatatgccttttaatagctttaacctagtgcccttaatatttttcaaaggcacctgagaaaagtataagaaaaaatttaaattcattttattctaatttttgaagtagagaggaggttttcggttccactgtggcattctatataatgtcaatcaaccaaacaaaaagcaaagcaaacaaacaccaacccagctcttcatgtattggtattaaatagatataatagcggggctggacgtggtagctcagacccataatcccaacactttgggaggccgatgcaggtggatcacttgaggccacaagttcgagaccaacctggccaacatggtgaaatgttgtctctactaaaaatacaaaaattagccgggtatggtggcctgcgcctgtaatcccagctacttgagaggctgaggcaggagaatcacttaaacacggtaggccaaggttgcagtgagccaagatggtgccactgcactccagcctaggtgacagagygacactctgtctcaaaaaacaaaacaaaataaaaagcaaaaagatgtaatatctggatatgtaattgaaattctactttttcagatacatgcttggttttgagtagacataaccaccctctttgtttcctgtagaagtaaacaaaatacaagccacatttttaatcagaaaaatgtaaatagaaaaaaatacaaatttaataaaaaatctaaattcaactcctcactatttcctgaacacatgctcattagctttcagtatatgaagtgtacttctagaatgataagaaaaataggcactttgaaaattaatgaatgtgattaaaatatgtagttaggcaaagggtagtttaagaaactgcacagttatacaaggaagaaaatgggctgagagagtaagtaccctccatctgagattgcttgtgacatggccaagggccttcagtgtgccctgcatcctaagatgctgttggtggggcagagtgggaggacttagctccacctttgtttttcttcatgcaccaagctagggaagtcaattttgccttcaacacataggacttgatttcatcattatcatcagaaaaagttttatatacctttctgtgtattcaaaacatgaaaacaagaatcttaaatagctatagacattgccacccagatgttttgagttcaaagtaattaacaacatggtaggacacaataaacagagccatctttcagacaagtgcacagcctgatgagacagcagattaaaggcttaatagggccaggtgtgggggcacatgcctgtaatccaagccccttgggaggccaagatgggaggattgcttgtggagttcaagaccaacctggacaacatagcaagactccatctctactcgcccccccaaaaattagcctggcatggtcgcacacacctgtagtcccagctactcgggaggctgamgcaagaggattgcttgagcccaggagttcgaggctgcagtgatcatgccactgcactccagcctgggcaacaaagtgagactttatcttaaaaaaataaaataaaacaaaacaaaaaacgaagggctttattgaggatggtttcagctggctaagttccaaccatgtttcccatcaaaatatggtttcttgtacttctttgtgacattataaaagcagtacatactcaaaacaaagaaaaattagaatatacaaamagcaaaactaagaagaataccctgaaaaataattttttccttttctacaagttagccaatgtgatggcattggtatatatctttgcagatgtataaaatagcatgctattctacatatgttttgtaaccagcttttcctcttaacatagcaaatacattcatgtcactagtcctatctaaggttatttgcttgaataagaacctaccactggtcaagaaggcacattacatgatacatagcagctcacatactatcttttttaaaaaattaaaagatacagacaactgagaatcatacatagctacattaagttagcatgaatctttattttaaacatttagatgatctgccttgtaagcaaatcagttcagtgtttaagagtgatgaataacaaagttgggaaggtgagtggaatattttaaaataatttgataaaataggatgggactgggttttggagatggayggatgtttgcacccagcttccccaagccctagaatatgtgtaggtgagaatatctagcactgtgcttggcacactgtgggcctggggagagttggaacccatttaaattagctggaagaagcagggattcagaacacaaagatggtaaaggtaagcagtgtcaaggggaggcaagaatgtgatggaagtactaaaatgactgtgtctcaaaaacagggagagtgttcaataaatggtgctgggatcgctggctgggcatatgcagaagaatgaaactgtacccctgtctttcaccacatacaaaaattaacttaagatggattaaagatttaaatgtaagacctcaaactgtaaaaattctagaagaaaacctaggaaatatttactagacatcatccttgtaaagtattcttcgctaagtccacaaaggcaattgcaacaaaagcaaaaatgaataagcaggatctaactaaactaaagagcttctgcacaacaaaagactccatcaacagagtaaacagacagcctgcagagtgggaggaaatattcacaarctatgcatcctataaaggtctaacatccagaatctataaggaacataaacaattcaacatgcaaagaacaaacaacccattaaaaaatggacaaaggacaggaacagactcttctcaaaagaggacatacaagcaaccaaaaaacatgaaaaaatgctcaacatctctaagcatcagaaaaatgtaaattaaaaaccacagtgagataccatctcacaccggtcagaatggctattattaaaagtcaaaaaataacatgctggtgaggctgtggagaagagggaatgcttctgcaatgctgrtgggaatgtacaatttcagccactgtggaaagcagtttggagatttctcagagaacttaaaaatggaactagcattccactcagcaatcccattactgggcatatacccaaaggaaaataagttgttctatccaagagatatatatatacttctatgttccttgcagagctattcacaatagcaaagacatggaatcaacctaggtgcccatcaactgtggattggataatgtggtacatatacgtcatggaatactatgcagccataaaaagaacaaaatcatgtcctttgcagcaacctgtttgcagctggaggccattatcctaaacaaactaacacagaaacagaaaaccaaatggcacacattctcacatgtaagtgggagccaaatattsagtatgcatggacataaacaatgaacactgtagactgctagagcaggagggaggaaagggagcatgggctaaaaaaaactacctattgaatcctatgctcactacctgggtgatgggatcatctataccccaaacatcagcatcacacagtatacccatttaactaacctgcatatgtagcccctaaatctaaaagytgaaattgctaaaaaaaaaaaatagcataaataaataaacttagatatgcccccctccaaaaaatgaggagagtttggtggtggaatgaggagggagaaaatgccctcaagtgctataccgcaacagaatccctggaagatgaaggagaagaagatgatggcagctaatggatagcatttacaataatgatgacaacactggatcgcgcttacatttcccatgtaccaaacaggggcctctaagcacgttgcatatatgaaccatttaatctttaccacattttgtctggcctaccttcttttttttgaggtagggcctcactctgttgcccaggtgggagtgcagtggcatgatcttggctcactgcaacatccgcctcctgggttcaagtgattcttgtgcctcagcctcccgagtagctgaaattacaggctaccatgtaattacacactaccatgcctggctaatttttgtatttttttcgtagagacagggtttcaaccatgttggccaggctggtgttgaactcttgaccccaagtgatccacccgccttggcctcccaaagtgctgggattacaagccacagcacctggccctgacctaccttctatggctataaggactaaatgaatttgtatttgtaaagtcctttaaatagtgcaatataaaagtttgttaataaagcacccttttactgagacacacagaggttaagtaccttgcctgaggtcacgcaactactcaatggaagaagtagaattagaacctgggccatctggtacaggagcccaggctgcccctgagagatctctggtcaactcagaaagtgatgggctgtggctcctcctgccctgatttcaccttacccacaaagaatgtcaaaggaggtgctgtctttctccatgggagaaatgggaatgaccattacagccgaagaattccaacaatgggcacctgctggcgagctgggggctgcattacttctgccccatctcacctcttcccatccactccatccctctgtctttatttgaggtgactgcgtgggaaaggcactctcttaggaggtttgatgtgacatcatttaggaaaatggaaacaaaatacagacccagtctgtagaaatgtcactattactggaaaaggaattaaaatctccttaaataaccaatgttttcaagatctctgggtgaagactcagagttaaggtcctccctttctcattcktttctccgttcctcttcctcttccctggtttctgcccctcaactattgacctgcctatctccctctccccactgtaacaataatggtcataacaagaatgctggaagctcacagtgactgagctcttgttgtgtagcaggcatgttaattcatgatctcctttaatccctgtaacagccttgtgaagaagtgactattttcttaacctactttatatgtgaataaattgaagttcaaagaagataaatcatttgactggtaagtggaaagactggaattggagctccaatctcttgctaaatccaatgccacacttcctctccttatcccccaaggtactggcgccaactccactaagcattcagttttccagcatcacctgattcttggaagataagtgggtagacatgcatgggcctccctgagttagatactctggcatgtttcacagatggtattccagccagttggactgtgccttttagccagaaaggttatgaaatgcaccaaataggatcacaggatttgttgtcaaggccagcccctgtttattgagtgtctacaatggcctggcacttgtggtagctgcagagagaaatgcagtggcggaggggatgtgatcctgctatcaagaaacttagcatttgaaaaggaaaatgagaccagctcacatcagaagaagaacctaagaaaaacatggtcagggggattctttggggatcgtgcctgagtgtctacccctaacactttttcccttttcagccccttcaagccatgaggtaccaaggccaccagtgggatagtgaacctgacgctaatggggatgctgagacatctgagggttgagttagaggtgaaggagcaaagaaagagaaagccagcctcttttcaaggtctgggcaaagagagcagattgtgtgcctcctgaaggaagcccttcacatatcttcatcaggatgtggtccatggaaggaccctctacttctgctaatcatggtagccctggaggagtgaggcagaaactagcagatgagcttctgcatctggtaggttgggtgtcctgccagtcctttcagtgcctcagcagatggtaacaggaagataaacttccctaccattttggactttctccttgcccagaaccaaacatctgacctmtacaaactaatagaacatgaccttcaagaaaaactatggcttctccagtgggattcaggaactagaggagagaaacccaaatggttaggacagacgactcatttgctgatagaagagacggagagatgaagatgaaaataatgagcattctcaaagacgtgtcattgaaacaccacaaagatcttctggacctacgttcatgatgtctgcactgaaatagctattagatgaatgagggaaaaatggcataattcttgatarcaactgaattagagagctgcaggattaagtaaaaggaaatacaacatgccgcaaagatggaaacacatgagtgaaaacgtaggtgacttaaagcacagatccaggaaatggaacatgcaaataataagccatccagaagaaaaaaaggaaagggtggaaaagtggttactatatccaaaatgaaggaacatttcactgagctgaaggaagaagttagtttcctgattacaagagctgagtctaagtaagaattaagacaaaacaaaacaaatccaaacaaaaacatgtaactcaacatatcctcattaaattcatgactattcagtgtactagacactgtggagtttcacccagatacccccttcaggactggggcgccctaactccccacccactgctgtccatatccaatactggttgatgcaacgtacaaaggaatggttctcttgtcccaatatgaaaactcaaactcagctcccataagatcagctgaggcctctgttaaggctgcgcgcagctactcagttattccctttgcccaatcctgcctctttattccttatagtcattgttctcaagagcactcctctgtaaaattcctcctgcccacaaatccccatctcagaatgtttcccagggaacctgacctatgacactttatactaaacaaagcaaaacaaaacgaaacaaaaatccaaaaacagaaacgaaacaaaattctcccttaaaaaaacccctaammtaatgacattttctaatagagcaatctgattagttgaaaataaaggagagctgggtgtggcagctcatgcctgtaatcccagcacttagggaggaagagctgggaagatagcttgagcccaggagtctgagacctgcctggacaacataatgagtccccgttctccacaaaagaaaaaaaaaaaagccaaaaaaattaaaggagaattggactagtgttatgcttgtctgccatatggaaagctgaaagatgataaaaattaagtgtatagagaaaagccaactgaaagctagagatggtgaaataaaatctattgtgagaaaaggtctgaaatcaaagaagcgtataattaagaaaatattgtttatttggttccaaagaaagttattttggaaacaggtaaggactctgtttattacccctatagcctttctgattaaaacactgcagaaaattatctacccgaatgacaactgaaaacaatggagatctcaagaccgaaaggatcggaaacaatggatcatgataatgatgtaattgagatgttgtaaaatattggtgagtatggattattggaacagaaagaatgagatgttgggaaaaactctggatttaagaggtgtggctgtgtgtgatggtaggggatagggaaattaatatcacagtgggaggaaataattatttaataatgatatgctaataggggagtcaacattaacttcagtagttatggaaggaaggtgatgtttagcacatttgacaaacaaaaataccttgcaaattaccaggaggaataaaaaaaaagaagagaaacttaacgaggtcagcaaaaaaatataaaaacaggtaaaaaagaaacaatagcaaaatgtaaaaaaattgaaattaaatataagatggaggaattaagtagatcagttattacaagaaatgtaagtggatataattccttttcaaatgtcagactaggttaaaaaacaaaacccagcttaatgccccatacaagagttatacctatgacaaagtgaaatactgtaaattaagggttgggcaaagacatcgacaactgcaaagaataacaaaacaacaaaccccaaggtatgaaagtttggattcatgaaacacttcaaagaaatatactatgtaatgataaaaggcataacctattaaggaaatatgatgaacacaaaatatcaaataacacaggagacaaacacataaggtaaaactgcactccagcctggacaacagagtgagactctgtctcaaaaaaaaaaaaaaaaagaatacaattgtagggggtatatttaataaagcattttcagtatctggtagattaagaaaacaacaggccaggtgtggtggctcatacctgtaatcccagcactttgggagcccaaggcaggaggatcaatgggtcaggagtttgagaccagcctggccaatatggtgaaactccatctctactaaaaatacaaaaattagcygggtgtggttgcaggcacccgtagtcccagctactagggaggctgaggcaggagaattgcttgaactcgggaggcgtggaggttgcagtgagccgagatcatgccactgcattccagcctgggtgacagagtaagaccccctctcaaaaaaaaaaaaaaaccaaacagtaaacaaagatatagtggatttcaataagatagtcaataacatggaacacacaaacacacacacacagatctatgcaaatgtgtgtgtgtgtgtgtgtgtgtgtgtgtgtgtgtgtgkatcaaggtactctacaggaatttttatctttatctgtgtccataaagcatttgtaaaagttaataggtaactgaccacacaaaaaaactaaatgaaatttaaaaagtagaggttttataggctacatttctgatcataatgcagtaaaactagacatgagcataaaaagttgacaaaaagttcttaaaattaaaaacactcttttaaataatccttggatcaaagaagrtaaccaaattaaagttatgaattagagtaataaaagtatttcctactatataggacattcaaacaactttgtactgaggcaaaaattatacccttaaattgtgttttttgttaaaaaaagattgaaaataaattttaaaatactgaacttaaattctaaagtaacaataaaatatgaatgaggaaggagggaattaataaagataaaagctaaaactaacaaaatagaagacaaacataaaaacggataagtaaaatcaaaattaggcgctttaaaaatattgatgaactggatacaattctgtctattatgactgaagagagagagggagagagaaagagggagaaaatgaaatgaatatactattataaaggaactacaaccacagatatgaagaagataagaaaatttactggtggatattatgtacaactccacaggaataaatttggaagcctagagtaaagggattttttttaagtaaaaatatagactctggaaatcagttatagcatgaagagataggaaatacaaataaatcaattagtagtagaagagtctggaaagtgaaataccttgcattaaaaaaggcaccagacccagatggttttacagatgacattatagtcttttaaaaaaatcatttgcagtattatataaactttatttgaccacaacaaggaatgacattcaaattgttttgtgaagataacttggaaagacagtacagaatttgaagaccaatttcaataaagaattatgaagagattttagcaaattaaattccatcagtgtatcaaaaagttatgacaccactatctatgacaatagactctatctattgtctatctatgacaatagatagagtctattaccagaactcaacaatgtgtctcagttattacaattctttagcaaattatataaaggcttccaattagttgtaatggatgtgatggtggtcaatgaatccttaaatcctgatttctgaataacttgttgattgcaggagtggggtaagggtagagagtggacattagtggaaaagagttatttagctttaggcaaatgcattagttatttgtgcttattgatttaatttttaggatgcaagttgaagagaagagtgatgactaagccatgggcctgtgataagtgcctatcatgttccaaacccttgactagggtgctttgcatacagtgtcctttcatttaacgatttaatcaggtctgggttaatatgctgagcacacactcattttaatagaatgccttccagaaacattcattgaggaccagaaatcaacatatcattttagaagaagttaggtaaaaaaggggcttatgcatcgaatgtgattattgcaattggttgcagataaacacgttaaatactttgctgacagatttygttcataagacacaagatatagcaatttcaactgatgtgcgagttcatagatgttcmcgttgctttacaagttcattagaatggttttgctggctgtaatcatagaggcatacatacgtctgctgcaaagacatcagagctcacctaattttcctaggctatcttaatagggtgtctgctggttgtaccatctctgaatggggaatctcttaatctcacaatgcaagggcagaggctttcttttccatctggcatagctctatctgaagaccttggggatcttagggaggagagtgatttccaacagaagggagaagacctttggacatatttttgtcatgaagcagcctcccatccttccttgagtatgtttcctgctacatctgtctctggcatagcctgggtttctcctgtttgccttgagaagggagattctttggtacatttacagggccttgaaagcctggtgccttcctagaaggaaggaaataatctttcttgtactacagaaaagaacagagcacagctctggctaaagtatgttgctaaagaaatttaaacagagcaaactacggatacctcagatgcaagattttgttacttaacaagtcggagtaataactactaagtcaatgaatctaagtctaccctataaacaaggattatgatatttaaacagggctttggctcacgacaattatgtcggcagccaattgtgatagctaccctgtctttctgcttcatcacttgaagcgacagtctccagctttccactccgcatctatcatgaagacacattgatttcctttctggagaaacacatatttcttttctcctgctaaaaagataaatctgacagattttaatcaaatgtagttgttcacaactatagaaatacatacagtgccacatatgaaaacaaaaatacaacactcccaaaggagaaggagttctatggccaagtttctttgtagaaaagacttgcattaatatacacacacacatgcacacacacacacacacacagaaataaagtctgagagttgtgtattttaatattttttaaggtagtgtatttgcttgtagtgacatcagcaaaggttggtctcaattaaaatttgcrctaaaactatgttctctgtatttttgttgaattctaagattctgtaatgttgggctttggtctttaaaatgaagtctttcccaagataaaacttggctttcagagggaacaccgtttgagataccatgtggaaaaatgaagaagtaccatgtcttgtatccaacggactctactaactgtatttttgtttagtatgtggctatgacgtgacccagtgtgtcatagagcacctgcattatttcatgtagtgattctgagtagcttttattagtagtctcttcaatgtgtctaaggagattcaagatgttatatctacgtaagattttttttctgaatttaggtaaacatttaaatggattttttcttaagatggtattaaaagtctgtgggagagggactgaaaattatcaaggtttgatgctttgtaccactcattcattgattagttagatgcccctcactatgagttatgcawaagctgagttttaatgacaattttcaaaatatctgagttgtttgcatgttttgtcttttcttctaagtgaagatatggctgattgtgttttcattagaatggagagcttggatgtcttttgttcatacctcgtggcaatttcctgtccaggtatcttggtctagtacatcttatttcagctaattctcagaggacaaaataaaaaataatctacatcatgaatgaaagtgcagagatacagttttaagtgacccttaatctaatcctaccttaagtagtccatcatttcaataaagtttcaaaattttattctcataattttgaatattgtattaagatatatgattcaagaagaatcatatattgggaagaaaactattgaaagttgctttaataatcctacatagtgattcatagtgtatatatgtatagaatttctttcgatgggcaaaaatagagaactatttctcttttaaaatgtgaactttaggctggacaccgtggctcacgcctgtaatcccaacacattgggaggccgaggcgggcggatcacctgaggttgggagtttgagaccagcctgaccaacatggagaaaccctgtctctactaaaaatgcaaaattagccgggtgtggtggcgcatgcctgtaatcccagctactcgggaggctgaggcaggagaatcacttgaacccgggaagcagaggttgcrgtgagctgagatagtaccattgcactccagcctgggcaacaagagtgaaactccatttcaaaaaaaaaaaaaaaatgtgagctttaataaattcccctttggtgtgcttccattgtcttttctaagtccctaaaaattacagacattattttccatatgataatataycctaagtgccctgcagtgcattattgggttaattttgatractgctttggtttgagaatgaacyggcaactctgttatctgtccttgatgtgtcatttacagatatttcaccctgaaaagcacaggatgataggagaaagagaaaagataaaaagtggccaaatcagaagttaccttgttagaataattttagaagaggttggcatttaacttgtaagaggactaaattaacttcttaatgtaaaaattaagaaaaggaagccaataaaagtgggtgaacttattcatttgaatatcatggtgtcctcattaagcctcagccaataaatcagtggttaaaaatttgtcccaaattccatctggtacttgtgttatttgaaaatttaacccaaaatgaaaggccatcctgagaaaggaaatacgtggtgttttcttgaaagaatatttgcgatgccccaacctacagctgctagaagatatgaaggcaagcacaaaatactacctggatcatgatttatacatgctgaacagacaataaactcactgcactcctttgccccmacagaaagtgctcacagctagctataactccagtgtggtatttccaagcaatattttccaaagttaccaagatttttcttatttacaaaagaagcaattcattttgtaggacatttcaaactggcaaatggccaacaacaattttgaccaaagctgggtgcaaaaggtattgcaaaacacaaagcaaaagaatattaaggaaagatggaaacaaaaaggaagattattcatccttccatatggctttttaaagccatttacaattatgcaccgcttatagtagtttctataacattttctccattgagaaggcagaagactgaatatgtttgtgaatgcattacaaaagaaagagaaaggattcggaatgacagtggaacttagctgtttgtttgagaatctgcagtgtgataatgacactgttaaccaggagaatggagaatgtgatatcatttgcttttccagaaagagatttcgagaacttaaccaaaaattaaagttgctagtgatagtatgaaaagtaaacaataacagccctaccacagttatgcatctgattgaaacaggtacagtatatctgaggtcctagaaccagcattttgttcatctgtctgctacccatggaaatgtacttcaaaagaatggagaaagtgtggactctctcaagatgtatttagataactttatacaatatgcacattagaccatgtgccatgccaccaattcatgtcttgggcctcccatggctaaactgtaaggagatttatagctaattaggggctaaaaaagattctgggagatttcatagtccatttcttatttgctgaggaaagactttcttacacaattccagctacattaaaagagactttatttgtcaaattattattattattatttggatagggtttcaccctgtcacccaggctggcgtgcaactatgtgatagtagctcmctgcagtcttatactcccaggctcgagagctcctcacacctcaacctcctgagtagctgggactacaggtgcatgccaccacacttgactaattaaaaaaattatcttttgtagagacggaatgtcagtatgttgcccaggcttgtcttgaacttctggactcaagcatccttctgccttggcctcccaaagtgctgggattacaggtatgagccactgtacccatcccaaattatctacagatatttactatcaatcccactcctctagtatcatcatcacttgacaagtccggatcatctgttttaaagaaaatgggctgggcacggtggctcacacctgtaatcccagcactttgggaggcctaggtggatggatcacgaggtcaggagttcaagaccagcctggccaagatggtaaaaccccatctctactaaaaatataaaaattagctgggcatggtggcgggcacctgtaatctcagctactcaggaggctgaggcagagaattgcttgaacccaggggggagaggttgcrgtgagccgagatcatgccactacactcccggctggatgacagagctggatttccatatcaaaaaaaaaaaaaagaagatgaaaatttcttaacctcccttttccagctgatgtgcgatgtcagacaagtcattaacactctttttttttttttttttccagacaaggtctcactctgtctctcagcctggagtgcagcggtgagatcatagcaccctgcagccctacccacctgggcacaaatgatcctcccacctcagcctcccaagtagctgggagcacaggtgtcccggctaatttttaatttttttgtagagacagggtctcacaattgttgcccaggctagtctcctaggctcaagtgatccccccacctcagcctcccaaagtgctgggattataggagtgagccactgtgtctggtcatgaacactgtaaaccttagctttcccacatggaacatggaaatgacaatgcccacctcacagaggtgacatgtgctaatggattgaaagcactagcatagaaaaacttactaaacaggctgggcacggcggttcatgcctataatcccagcactttgggaggctgaggcaggaggatcatttgtggttgggagttcaagaccagcctggccaatacggtgaaactccgtctctactaaaaatacaaaaattagctgggcacagtggcacaatcccagctactggggaggctgaggcaggagaaccgcttgaaccctggaggcggaggttgcagtgagccgagatcacaccactgcactccagcctgggtgacagagcaagactccgtctcgggaaaaaagaaaaatacaaaaagtagcygggtgtggtggtaggtgtttgtagtcccagctactcaagaggctgaggcaggagaattgcttgaacccaggagggagaggttgcagtgagccaagactgtgccactgcactccagtttggacgacagagcaagactccatcaaaaaaaaacaaaaaaaaratgaagagcttactaaatactagagagctaaagacggaagtggaaagaaagcaggagaaaatgacttggcttgtggcttttaggcttccytctcaatcatttctatcctttcatttctgttaatttcaacaatgctatcsacaggaacatctgccagattcctgtgattcctcctcattttttcctgacatactccctcgtcatcttgtttcagaccattctgcatttggyatctcagaacttgaagaaagtaaatcttctctggaaacagagtgactttctactgcagaggaagccaccactcttgggtgttccctgtggtaaaatacgactctgatacagcaaatgatgccctggggctgaagtagcgaatcctctgtccaaagcactcggccttccccaagattagtcatttggctgtctctctgctgctagtaattcagagataatcatgttaccaagatgccatttaatctgtatttggcgtatctcaagttttcatcttcattaatagagccatcagagtttcatcgggcttgactggtattggacacaccagtgattcacccggggggtgaggtttgcagtttgcatggagaaactgtrcttgccagatggcagctgttaatctgcttgcatcaggggtgcgaggaggcctacgtttgcctggcccctagccagtggggctctccctcacctctgattatacaatgaccttgtggcaggccctgttctccactcccagcaggcctgaaggcactggggggattggatgcctgatgaagggaaggaatactttttctggccttcttacaagaaagattgctaaccaaatctttgctacctatagcctaggatattgaaacataagctctctatggaagtgttgtaggcctttctccttagttcagctraaataggggtcttgtcacacaaccacgaaatattaggcttgcagacactttgaagggttagaaaaacggaatttattgggcaaaagggaataaaaggggaagcagattctcagcatagtgagagtcctgctagtacwggcttcccacctcacaggctgaatcccaggtaccacccaggaagagaaggagccaggctcctccctcctgcaaatggcatgagcttcccgagactccacactcctcccagtgtgcaggccagtcagaggttctccaggacccctttatacgtggctgtctcagagggcagtctacggtggaaggatgtgaacctgggagtcagagaaacttggctttaaatccagacgccagcatttaactagcgatgtgaagttaggcagatcacttaacctctttgagccccagattcttccattcacatgctatgaacctgataccrtcatcatggtgggtgcttcatagtcaacgcagggaagtcagatggagactgatccatgagccccatgacccagctgtcctgctcctgggagtggaacccatcccagcattgggtgtggtggtgaggatggggtgactgaggtgtttttcgctggggagatgggtagtgagatgtcagggaggctcatcatacaatgctatgcagcagtatgaagcagtgcagattaaatcttaaaaactgactaagagggaggaaaaccacaaaaacatctgtgggcaccatttatgtataaacatacatatgtgtatatatgtaaacatgtatgtatatatatgcttatacataaacgtatgtgtatataaggtacatatacagacagarcaaggaaatttggggtgtcttatgagaatgcatacaaactcaaggatgtcatcgaacacaatactgctattgtttatgggttgtgggaggaaaatggaaggggaaaaggagataaaagttaatgaacacatgagtgaagggcttggcacaaacttgtaacgatagcgtgctatgagttgaggagtatgacttactcaatgttctgtcctgggtctaaaagaaaaagaaaagttcaacaaaaaagtcaagggaagggggagaatataattctcagtaatgctacgggggcttcagggtctgggtgtgaggaccggcacccaygtggctatggaatagctctctcccttggctctctctctctctgttgagagtgggaagaaatttcaggagaaatataaggcatggcccaagatactcatttgctcttatgtgaactctcggtctctcagtttctagttgcctaaaggcacttctctaatttttcccaattctcattgcagacccagttttggtgacttggtcactgcagacctttcagaatgtgtggtgctcattcttgttaaaccagttgagaatttccccaatcctttggccctgcgcacaagtgtagctgctcttccaatcaatgggacctttgtatgcagcagggcggaaggatattattatgtgacaaatgaccacagggaaactcccattattttccttgtgtctgagaaattataaatgtgtaataaggaacactttgtagtaacccttgttaatttatgattttaaatatgaatgtgaatttattggaatgacacaataaagagtcaccatgggcaccgattataattatcaccaagtacaatgaagcagagaaagaaactatctcgctcctaaatggcatcatccatataagccttgccttgttcaaagctactctgtaktattttcttttaaataaaataaataaggcacaaataaacaacataacctaaagaggagatggaatggtctatttctttttgttttttggaagctaaatttttgagataacattaaagataaaaatcagcaagacacctctgggctacgagaggctactcttatgtcacatgtccatttatcaccatcatcttctctatgttctcttcccttccccccactttctcctcctcctacttcttgattagccagtcagatgtcttattcttctgaaggaagtgatttgttcagagatgggtacatgataccaggctctgccaatacaaggcttgcctgagacattggttggagatgtaaagaaagaagtatgctcacttctagaagagccacatataaaccattaactgcagtgaagaaagcctgatgaaggatgccaatggagaaggaagcagagcagcacagagcaggagcaatagttagatgcgcatgatgacattacttgagtacctggatccagccacacctgaaaactgaactctctaaactcctcacttattggaactaatatgtttctcctttttggttttagttggtttcagttgactttttactcatggcaaaccaaagaytttttttttttttttgagacacagtctcattttatcacccaagctggagtgcagtggcgcaatcttggctcactgcaacctccacctcccgggctcaagcaattctcctgtctccacctcccaggcagctggaattgcaggcatgcactaccacgcccagttattattattattattattattattattattatttgtatttttagtagagatggggtttcatgatgttggccaggctggtctcgaactcctgacctcaggtgatccacctgcctcggcctcccaaagtgctgggattacaggtgtgagctgctgcacccagccagcaaaccaaagatttctgagtaacacaccaagtaagaaaggcaaacactgccacactgggaagcacacactcatttattaaacatttagcatgtcttactctagaacaggaagagcatttgtacagatcatatgactcatttgaatcaatttcaaacaaagagaacaagtctgtgcgttagttcaaagatgcctgccatatctttgggtatctaaataagttcgcatgtgtgcttttactttaataaccaaaaagaaatgtggccataggttgggttacctggatcatatattctaactagacagtaattcataaattctgtgccagcagtttcatttgtgactacagttgcgtgaagtcatgaagaactactttaatagtcataaggtgatgagctgtatgacctaaggcaatttacttaacttctttgtactgtcagtgtttatctgtcaagtggmaataataagagtatctacttcaaccaaacttccaccaattcttctgagtaataaataagcaaatatatgttaagtgcttagaatggtggctggcacactcactcagtaaataatagctattgttattcattatcaccaccaccatcaacttcatgtaggaagcttcacaagcagtttgaataacttgcaaatatgcagaactttatttaccacttacaaagtacttttgcctgcatcatccaatttgaaacagtaaatctatgctgccacacaatatgcgttttacagtttgccttcttgcaattgaaaagagcagtttttttcaaatatttacataatattttgcaagatgcactgaatctcgtatcacatatgaatgactgaggaacactttttttttttttcctgcagaagagttaaacaaaaacatttaaaatacaaatgtggactggttctggatatcttttaccaagattggaaatttaactgcttaataaaactttggttatacctgttatatttgtcaacagacctaatcatgggaaataaaatgttactttgttaagagttactttatcttttccttaatatatcactgatatcaaaaagaaaagggtgaagcaaattcatactttcatgtcattggtcatttaaaatatttttaaagttggacctcctgaaagacttagtgtgtttcatgtcaccaacgtaagcagattgttgaatttgacacatctaaaagttttctttgtttatggaattttctcacaaagacctgctttcaaaatgctaaaatattcattcatactaagagttttgttgttgttgttgttgttgttgttttgttgttttcccccacacgaagaagctttgaattaactgggtaaaatttttcaatagtcttttttcttttttttgagatggagtctcgctctgtctccaggctggagtacagtggcgccatctcggctcactgcaacctctgcctcctgggttcaagcgattctcctgcctcagcctcccgaggggctgggactacaggcgagtgcccccatgcccagctaatttttgtacttttagtagagacggggtttcaccatgttggccagaatggtctcgatctcttgacctcgtgatctgcccgcctcggcctcccaaagtgctgggattacaggcgtgagccactgcgtccagccctcaatagtcttgtttaaggagatgatacaattttattcttgtatcaatttctagaattyatcaaagtttgctagtaattcttttattttggaccttgatggtattttatccaattcagggaaaacacacctgctttaataactgctaaggggacaaggatggtgtgggaggaaagatttatataactarttttacaagtgtaaattttaataatttcttgtatagcaaaacaaaaaccaaaaagcatatacaataaaactttctttggtatttagatggtatttttcttgtcagagctttggccagaagctagaagaaacaattgagttctgaattgttctcctctgtttaggctaccgtgttactaaaaggcttctgatattgcaacttttttttttttatagttagtaagtgttcctcgcttgtatccttgatggactaatctattccccacctagagagtttgagttattttctcaagagtagttagttgtattttcttcattgtgtatcacaaggtaaatgctaaattctagacatatattgacactcacaattatggacaccaatcattttgtgaaggtaagccatactttttaggttttatgaatactgaatgcattttaaaagacagccagattctcccagtgtttacacaatgggactaaatgagtgttaataacttaggtctcttagaagctgtatgaagatatgctaacaaaattctttgctaatacacagaagagatatgccagtgttkgtggtgtgtctgtcctagagaaaggaaccctagggacaggctttcttattcagcttcatatcatcaatgagcatttcagggaccttagtgctaagtgttcttgaagtgatgctcaaattttaaatttaaacttcgcaaattttatgcacatattttaggtgagtaatgcaagttcaatccaacactccatacacaaagggcacctggatattcctaggtctcagttatgggaatacatgaagtcaaatgaacattcatagctcttgagatccttccatggccccaacaagaccacctgtcatggctggtcccttcttttgcttcatctgggctccactgggcccagcagttctccactgttgttcctggaggagtcagagtggctgtgaagtctgtggtgaagtgtgtggggcagatccctctgtctgtgtgtctcacttcatcactttagcctgtaggcagtacagtttggacctgagtctcataatggcttttgtgaaagagcgcatcagactgagtttctggcaccatctgggaaacacacagcattctcttccatcttggcttcccatgtcttcccagaaccttgtgttccaaagttctttttagtccagaccctcagcagtgttggacataaattcacgcagatacgtgttttggggatagcagggtaggaagtttgtagccccataagtcttagcacatgccacactactattaatatgtttccttttgacggatggctcaggcatagagtgacaatttgatctcagaatataaatagacccagaggttttataaaaagcttcttttgtgattttgtggtgatgactgtattggacttttaataaatttaccacctatagatgatggctgtagatacagacaccaacacaaagagtgaataagaattaaaggaaatctgtgaaagatcaaaataacaaggagatcatcatggtatttttccggggtggttcagatattggagaggcrtgggagtgttcagtagtcagtgacttctgcatgatatttgcatagagagaactttaaaaaggttgcatttcttttctgctttcatatttactttgggttaaggttataggatctccttggcaatgttgctgatgctatttttgtaaaccccaaatcagtgttcaaatgtggtgggatggaaattttgagctacagcaataataaatacattttatgtccccgtaacattcaagctgtagtatgtctaagagtcagtgaaagttgtttcctgccttgaactctgaagtaagaaagaaacttttgtttataaatgttagagattttgtttttgcatttaccgcaaagttaagtgcagatataatctaatcagttttggcaaaatatcaagcgtgcttgtttgtttgataagggagggaaacccccaacttttcatgagcgcaagtcctttacctgtgttgaagatacatgacttctgtccataaagtcttcgrtcttgtggactcatacagaaaacacgggtcctgtacaggaaataagaggcagacatgtactccagaacatctttctcatccattttaataatgtctggttttgaatttataggatttcatataaaggaccccatttataagttttttattcttctcctctaaagatgtaaaactttatatgctgattcgagtgaaattgagagtagtcaatatcaatcaaacaaagattatttaatatgcactttagcatattctatattggatttcttcacgagaatatttgataagagaacaggtgtgtgtgtgtgtgtttctatatctatctttctatgtttttcaactcaccatgcttctacactataatctccttgaagggcagggccatgtggtattcattttgttaaccttgtaacacctrgtgggacactctcaagacatgaaaaccagtttataattgtatcaactttacattctggaagatgcctgtcagtggccttttatgtaccttgcacccatctggtggggtggattgggcaagccttacagtccttattttatagaagatgaatttgaatttcagagagagtgagtgatttacaattccgggcatgtctttcaccccatccatttcttgtggcccatctctggacactttatgttgagggaaaggagcattaccctgcaagcctggcaggaagaagggctgctgacaaatggtgtgtttgaatttatgggttgggctagtgacagttgacagagccttcctatagagacacaggattctccatcaccactggcactttgcccctaggaccacaatgagtatcaaaccacatttaagacaaccgtgaacaaatttcagtgggattggcaatgagatttccaaatggacagatcttctgcctgaaggtggtcatcagcatgtctatagtgtatagagttctctgctaaatccacagcttctgcttcacctaactttttttttaacctggttttgttcattgcagatagagttctctctctgatagccaggaagttgtattgagaagggatcagccacaacaagcttgactcactgggcacatgttaccttttgttttttgttcagcacctctttatataacaaaactgtctaatctctcaaagtcgtaaaaggttaacatttaactaagtcctgcatgtcattctgggatggacatcatgacagtttggcatgtcctttggcattgtgtttgtgctgatacatttccattcaatttacaaacgtttcattgaatgcataccacatgccaggtgatagtgctgctgctggggagaaggtgggaaatgaggcatacacaatccctgccctcacagaacctagtggggacagatgagaagaaaggaatgccagtggaattagtgtgatgaaagaacaatcccatgagataggaatagcttttttagagcgctaggcattctgaaactttctggttatctcagatctcagattgcttaagcttcttcatgcccttacaggtaggctcyggtcttagtagctctgaaatattgtgaaagtttcgtgacctcttgggaccatagttttatcatctgtgaaacatagacattaaagtggaggactttaaaagcttttgcaatcctaaagtatcattgttgtattattgcaatagctaacattgatcaaagtctgacaaggtgccaggcactggacagggagctcttataagcattgtttaatttattaagtgatttttgtggatctttttgtataaacctggatacaagcagcctaaggagggrcatggcaggtactctggtgaaatccagataaccatcaagggagcaggtggctttgtctagatctctttcccaatttagatgttttatatacttttcaggggaacttgcatcacatctgtacacacctatgttatatttatataatatttgcatgtgaactctttgttctatttaaaaatgatcaatttgatgcctcaaaagtttttttaaaagcataaaactctaatgacaaaaaagcagttttcaaagcaaaatgaagtcctcccatttggtatagtcatttattttaaaagacaggtacattttaaatgccccctatccagctgtgttcatctatgtctccttttgtagagttatttaagtctttttggaattgccttgtgtcattttcaaatgttcttgaatttaatgtctgcacgacattcttaggcagacttagtcctcagctacctgccagggatgagttcacattcctttcaataatgagaaagcaggaaaatggacaacacatttgcaataggctcaaaaacacctgccaggggaaagagatgagctgtttgatgtcccatgtcccaccgacctggcaactctgttaactaacagtgatgatgaagaagatggtggcagtggtggtggtgatgacaggtgcgaatgtggactgagccactcaggaacttggaaaattatttgcatagctatttcattcaatcctcataacaacaaactgaagtagacgtgaatatgtccattttacagggatgaaactgagtctcaatatttgtaaccaccttgctctaggttactcagtcagtwactggacaaggtgggatttgaacccaggtcaatctaattccagatctcaggccttgagcttctacatgacactagtttaatcccttcttgccaagaattctttctaagagataaggcaaatctgctgtactatctttaattctataatgatatgaatagagctattattattttaatattatcaattagtaacttagaaattctcccaaagagtcaaacaattggaaaaagtacaatgtggcacaaacctcacaaacttttagcagttcrttatttggtccatgggtgggaaggcagcatggcacagaggaaaragccaggacatgggctaggctgggctgggctgggctgggctgggttagagacctgggcccatactgctgactacatggacctggcccatctctaacccctctaagtcctaatttcctcacctacaaggagtggctaaaatgtctttgttgaaagaatgttagattgattgcaaatcataaattaaatgtgtctgggcagtgtctggcaacgcaagtgctatgtggttcctactagataaatggtagaaaagctcttggcacaaaccgcccaagcctgtcatgctcctgggataaractaccttcaagccctgcctgatttcattcctgtccatgtcaccagccccatctttagccattttccttttcattgatttttttctcatttctcatgtgggacagtgtcacccttccaccccagggtctttgaatatgccatttccttggctgaaaaataatctttcacccttgtatgaatgcactgttctgtcttgtccttgagatctcagctcaaatgtcacttccccaggggagtcttttctgaagccccaaagcatcaggccccccttatagattcccagggtgctttccgatttgggatacccttcccagtggtaattaagtacttaattcaccattaattgtttaatgtctgtctccatcaccagcattgacctccaacagggcagaggctgcatctgccatatttattctctctccccagatcctggcatggggcgtcgctcctagttggtgcttgatgaatattcattgaatgaatgaataaatgagctgatgaataaaggattgccttatttcaaggatccccctttacactttctaacctgtttttactaaaagaagaccacttgatgtgagccaggaagacttttaccaaaagtttttgccaaaagctgtgccctttttacccctgatgagagcagaacttcctgggggaccatttgttacctgtggcgcagaagccttgtgtaccaaatgagctgcatccactccgaccagagcgatacactggatgataaaaagatatcacctccctgaaacagatgcttcattttatgatagaaacagagacgctgaagcctgcaggtgccgggctgacacgcgctctgcagagaatcattagagcctccttagagaactgggtttactctgtgtttaatcagccccaggcagaagaaatggcttcatttcagctcgacgagagccagatcacaaaaggaagatagatggccaatacggctcatcactataagcatattgtcttaatttgaaggaacagcctggcacccgtgctaatcaggaaagaaagtgcaatatggctagcactgaaggccagtcagtttaactctcagtgtaccccttaaggagaagctctcatttattttcttaattaatattttaagggaagtgagaatcacaaaacacattactcaatcacttaagaagttccttggcttagaattaaagatgctccaggaaagactttttatacctgaaaactgtgaatctctacctagaaaaaagtcttaaagccggtgaataaagtggcttaggaaggtaaggtctattaatttgctggctgcttttaatattggtcacgtttggcagttgatccagaaatagctacaaatagagacgacatcagatctattgtgtggaaacttgctggtctcttgtaggctcttgtttttcatggctcagtcctgtgcttgttcttcaccaccctcagctttattgaggtgtaattgacaaataaggattatatatttaggctggacatggcagctcatgcctgtaatcccagcattctgggagctgaggcgggtggattgcttgagcccaggagttcgagaccagcctgtgcaacatggcaaaaccctgtctctacaaaaacacaaaaattagccaggtgtagtggcagctactggggaggtttaggtgggagatcacttgagcccgggaggctaaggttgcagtgaactgagattgagccaatgcactccagcctaggccacagagccagaccctgtctcaaaaaaaaaaaaaaggttrtaactttaaggcatgcaatgtggggttttgatataccttgtaaaatgatgaccacaatcatgctagttaacatgtccatcatgtcacatcattacctttctctcccttgtggtcaaaacatttaagatctactctcttagcaggccaggcacagtgcctcacgcctgtaatcccaacattttgggaggccaagtcaagtggattacttgaggtcaggagttagagaccagcctggccaacatggtgaaaccccgtctctactaaaaatacaaaaattagcccggtgtggtggtgtgcttctgtcgtcccagccactcggcaggctgaggcaggagaatcgcttgaacctgggaggtggaggttgcagtgagtggaacctctgcattccagcctgggcgatagagcaatattgtatcaaaagcaaacaaacaaacaaacaaacaaacaaacaaaaaactactctccttgcaaactgcaagtatacaatacattattattaactaagttactttctgtacattagatctccaaaatttattcactctgcataactgaaatattgcaccctttcactaactcgcccgcgtccctcctcacgcgcttcccctgacaaccatcattgtaccctcttcatctgcrtgcttttgcccctctagaacttgccttggttaggactgcaaaatggatattcagttcagtcgctcttagcttctcgattgccccaaaatgccagaaaagggattttaagcttrtgaggagcaataatacatatctgaactcagcatccttgccaaacctctcttatttgaagtaaaagcagataatgagtagtgtgggtacttacaaacaagtggatgttttagaatcatttggtatgtgtcacatccatgttttcattatatcccctgagccttagcacaaagagctttaacagcccttccaccccagcgactgttttccagatgttctgaaacaacatcaagtgacccactttacccctgagagatacataaaggtgcatttatggagagactggatgagtgaggctgagacattcgctcagcagcttagtcctagatartctcccatgaacgcagtatcgaatcttactttttacctaaggcacattgagtacggtttctagaaaatgatatgcgaaacactgctaaagtgaagaagaaacttaagaagcttagcaacggrtgtagaaatattatcatcagctatcagggtaatagtatccagtcattytccacctacaggcacaagatttaggcttaagcagctgaagacaacacagaaagtgtgcagtcttagagtgtttaaatatcggcacgtcaaggggaaggactttaaaacctggacaagtgtcatttgatttttgtgctggataggatgaaagcaaaatcacaattgcagaactgaaaatacccaagaggcacgccaaggttcattgagaagccataccatggaaacaagagaaatcatcatttgtagataggagattgtttcattctttgcacatgggcagcaaataccagagcagtctctgggatcagaacccagctctttgcctctgtaagggagatgagccatttctcaaggaccaacaatatgttgccttatattcagtcataggggaagagctactgattccttccaaacatgggcatcaggccacatgtcaaaatctggcaagaaggtgggagaattcttccatagcacatctgtttgtgtagatgacattgagtgaaaaaggtgccccctccccaactcccaaagtaagcaacatgccaaaatcttgacgtgaaatgtacttaattttctacagtatgtcaatcacccaatgtctgctgtgcaaaatgaacaaccttctggcgtgacttccattgccactggcacagaactcactgcagtcatcccgttgaggtactttatgcatgaaagggaaagtgagcccacgtgaggggggtcggacagctctcagaatgcctgctagtggcctgctgtttagcaaccatttacatgggaccaactaatggatgacagtcctattgctgagttcagaaatagacaccctctcatatcttgggaggctgggaagtcttgcttggcactgacatgttggtctaacttaaactttggtgaagaagtacaactctgactgcatgacaaggtggatgcccacttgagataaaatgaactactttttgctttgaaaatctgtggtctggaacatccaagattgatcattttgagtcaattgccattgctggtgcttttctgattcctgccgctgatttgttcatagttagaaacatgagttaaattacccttatcttaacatccttaaccatcaatgttgttattggtcataaaattaggcacttcctgtcatttcaaatccactgacagttttgggtggtttgagttgagtgggttggacaaggggaaataggtgatttccgctgcttcttgtggagttaatctctcatccagatactgctaaagcatctctttcaacggcagtctttattcttagtttagcagcatcagtgtaaacaacaagtttctttagaatgctccaactcaaagtccaaatgacagatgatttcccagtcctgaagaagtcatttaagcacttgtatttcttttcttttgtttttttttttttgttgagatggagtctcaccctgtcgcccaagctggagtttagtggcatgatttcagctcactgcaacctctgcctcccgggttcaagcgattcccctgcctcagcctcctgagtaactgagattacaggcacccaccatgaagcccagcaaattttttgtatttttagtagagacaagctttcaccatgttggycaggctggtctcgaactgacctcaagtgatccaccagcctcggcctcccaaagttctgtgactacaggcatgagccaccgcacccagcctcacttatatttctttcagcaatttattccagtttgaacaagacagtcaatttctcatttaaayatggagcaagcaggttatgtgtgtgsaaacaaaaatatctggcaaccattcaaggtttggatgaaaagaaggatgtggaaacatgttacagctagaaatgattactttattgtaactgccatttgatatctrggggcttctctcttctctgcacaaatctctgttcttaaaagtccttttggggaagctccgggctccccacaccatcccctcctccaccaaatagctgctgggctgctcacatggtcaagctggccttgaatctagaaagtatttgcagcttcatctatgtcggcaagttttcctttcccctaagtaaaacacttgtttcagctcacatgttttgttcagtgtgaaayatcttagctgctaaaatgtcacttctgtggcaaatatttcctcaaggaaacatttgtaaatatcttcaaaaagaaggactcatcccttacaccaacaaaaatatagccaagtcagcacatgtgtttctaaaatcctccttcctttataaaagtcaggctttttcctactaactgatcagcaggaagaagtatatatatatatgtccatgtcctccatgtacttgacctactgaggctcagaggggctaaaacacctttgagtatagcattgatcttagcaatcttgtaatggggtgtattagtctgttttcacactgctgataaagatacacctgagactgggtaatttacaaagaaaaagaggtttaatggactcacagttctatgtggctggggaggcctcacaatcatggtggaaggtgaaagggacatcttatatggcggcaggcaagagagggaatgagaaccaagtgaaaggggtttccccttatgaaaccctcagatttcttgagacttattcactaccacaagaacagtatgggggacactgccccagtgatcaattacctcccaccaggtccctcccacaacatgtgggaattatgggagctacaattcaagactagatttgggtgaggacacaggcaaacaatttcacagggtttccaactggcaggtttttggaaaactgagaccagccacttgtatgggtgcctctcaagggatcaatgagaacaggaagtgatcaatgctctctcatactcatagcatgtctgggactctgagtgcccagaattctgccccatgtagaatagaaccttgctaaaggttgagcccaccctaaatctagaggaatcaccgctgcacagaaaacttctatcaactcctttctgtgctgtgtgaacataagactcatctcagtgtaatgttgtgagaaaattcatgctccatcactaagaaacagctgtgtgttgccacagtcattaacttttgaaagatgttaaaggcaggtatttgtttgaagccagtcacttcagacagagcttccccttcaggtttccttctggttctctaagtgttaccttgcttctctgatacaagtaggggaaaccagcaccagaaatttatggcttctattaagagggttggctggacgtgtggacaatatgtcaataattatttctggtggggatctaacagcagaggaagtgtctttgtagaatagcttattttaacagaagacagatctgcctgacctgggttttatgacagatgtcaaatatatcgaagtgtgttgtgaagcagattgccttattggcaaagaaatgaaagaccaccaggaagatgtatgggaaactttccttgaggggtttcgtgcctcttggtgcaggtgcggcagtaaacctggagaaaggccagtgggaaggtgagagtggagactgtggggagcagtttgaacttctgcctatccatgagacttggaaacaaaagaccctaagccccagagggttgatggaaaatggggtggaagaaagggagagcagggcagctcacaygagagcagttaagggacaagggtaaagcaagtgaggccaccygagagagagcaccccctcacttgtctcatctgaggtgcctgctcaagaatgggttgttctccaactttccttcttgagttcagttcaacaagtatcagtgccctgtgccaagagctgagctgggcattagagaagaatgctgaatacacaggctccctactccagtccccattttccttcctctggaaagaaaccactttagtgtccagggaggacatggtgtcctggggtcacttattagctgctgggtagcctgaggcaagtgtgttcatgtctctgagcctcatttccctgaactggacaaaggagctcaggacctgccccatagagttgaggattgagaaggacagtgcccttgtacttgacccatagtaggtatgggaaagaaggtttaggagcccatctgttctgagtttgtccaacrcacagtgcttcatagggctcytccagttctcatttactctctacaatatgggaagtacatttcatgattttgattaaaaatgaggaggcagaagggatggtaaagagaatcactctctgatttgtggcactactcacaatagcaaagacttggaaccaacccaaatgtccaacaatgatagactggrtgaagaaaatgtggcrcatatgcaccatggaatactatgcagccataaaaaatgatgagttcatgtcctttgtagggacatggatgaagctggaaaccatcattctcagcaaactaccgcaaggacaaaaaaccaaacaccacatgttctcactcataggtgggaattgaacaatgagaacacttggacacaggaaagggaacatcacacartggggccaccaaagtgtggccaccaaaaagttggtcagatacagaaactataaagggagtagtgaggatcactcaactgtttgcctttcgtctcaaaaagacggaacttcaggtaatttatgtggcccttcactgaaattatcttccattagattataagctccttgtattcttattccgtgagcttcctttgtcacaaaaggttagcaggaaactgtgccccttgagacagatggataacaaaaaagccaccctttctccaggctgctgtagtcagtaatggtggcttcggtgggaggacaacatggtggttttcagctgccccttcaaccgggctcccatgtctgggcacaatctacaccactgtttgtggtggccctgtgagcccttagcacagctaagcccgaagtgcatagtcagtaaatgttttccaactcaatttattacagtcactgttgtgcagaaaatgatggcattatgttttcaaagagattactttagtcattggaaaaacataatagagaaattatgggtaaaatgtaaaaagtcactgcaacagtattcttttgtgttcttaaatgtttcttctttgagtccatcatgagaaagaatacagtatttcattccttctggctttgctggctataaaccattaagggttttgtgtgttttttaagtgattggagggcccatggactacagttatgagaaaagcttggagaaactgaggcaggacaaatmattaaagaaggatatttagactggactcagtggttcacacctgtaatcccagcactttgggagcctgaggtgggaggatcacttgaggcccggagttcaagaccagcttgggcaacatagtgagaccctatctctacaaaaaatttaaaaggatatttacatttttacatgtgtgggattccccaggattagataaggtagctgaaatacagaaaccaagaaaagctcacagaaaatgttagctgtggtatagaatattggtttgaactattttgccttcttcttattctttaaaggtggtctcgatggtaaaagtaaaatccttaataaatggaagagctgtacagtcttctgttttggacttttgtttgtcccattttgtggtagtatcatagggaaatctttagaatgcagatcttgtttacttgccacttctcccccttgatctactgggcttttgaccacttcacctgcaaagaggaaactctcagaaggaggtggaatgtaagttgttttcatagattttaccctccaaaccaacttccaaagtgattaactgctttttctaagaagcagagagtagaaatgtccatgcagaaaaaaaaaaccagcagtatctgcttttatgtttaaaaagtggggctggacatggatggtggctcatgcctgtaatcccagcactttgggaggccgaggagggcagatctcttgagctcaggaattcaagaccaatgtgggcaacatggcgaaaccttgtctctaccaaaaatccaaaaatttatggggcatggtggcatgcacctgtggccagctactcaggaggctgagatgggaggatctcttgagctcgggaggcagagaggttgcagtgagctgagatcacaccactgcaccccagcctgggcaacagagcacgaccccatctgaaaaaaggagggtgaagtgggtaaagtgcaaactgaaaacaagaatttccctggaaatgaagcaactgccttgagtcagatgctagggatgagatttgtccctcctaaggaggggttgctgaagtccttcatctcttagcctggcttgacatatggaaggagaaatgatattcaatttgaatctagaaagtgtagaatctgtcactgggcagaacaagggccacatggcttttcaaccacaggactatttcacaaattcatgttcttttcccttcattttgactcttttttggtcccctctgctcattttatttccccttgagtttgtattaaattcattacatgctcttaagggagagaggttctcaagagtggggaagatgctaccagtaaaaaaaagttggcggggggaagaagtcagccttggtgcattgaactaaactatagtttatctcaaattatttccccccttttggagaacaatctactkttctcctcgaagaagcttaaagtctcaaaggcctttattaacttgatctttgggaatagtgttttaatttttccataatcatcatgcaaattgatcatgataatmtctggaaaggaaaataagtgaaccaatggcctcattaactccagtgctagggagacccatgttcctgagagctggtgcctttaccccatggtggctcaggacttcattgtgtatgacttggcccatacccagtgggagctgtggaacgttccctgcctggcgtgtttaaattgcctcatgcattttactcccttacaaaataataggggaaaggttccaaccttacaaaagaaatgtttgcattctactcagttctaagcaggatctccgactctcctataacagaaccataccactgatgcaacatgtcttttccggactttaccttaatgacattgaggtctcaaattgctagaccttgggtgataattgagtcagtcagcattaaaatgtatggctcagatgcataactctgaatgctgttctgctgaattaggaggctttttagagtgtgttttaattttaatttaacactgacaatggcaaagacaaatagatctgtccaaaatatacttagtaacagttttttgagttggttattaattttatataagtagtttctctttttatttttatacactataaaattcagtagaaatcagaatcaaatgcaatacacttttattgattgcctgctatgtgtcaaacaaggtgttgaatgttttcgaatgctgtctcatttatcctcatcttacagatgaggaaaatgtggtgtaaagaggtgaaatagcttgctagctggagaggggcagagtcatttacagatctacctcatcattgacaaattttggatgcaacgctttgaaaattaatttcttcagtgctacgtacagctaataactgtttctcagtagaccttgtcctatcagtgagtagaaaggaagtgcttataagcctgggggccacggggcaccataaacatctgggcatggattgtcactcagtgggtgtccaggaccatactttgaggcacaccagtgtctttcactgcctcatcatatctgtggctgaaaatgatctcttcctcttttggagacaattgccttctagggaagtacagatgcaggaaggtatgcacaaagctgatgttggaaagcaatcacctaacaaccagatgggttagccaaaggcatctgcctcctgagacagagcagggccacatgcacatctccctctggaaaaccccatttatctcagctgcagtgagaaaaggggttatatgttcttttaatcacttctacctctctggagaaattttatatgaatatgcatcaacaccaactacctgtaagctattatgttagaatacaataaactataccttctaccagctttgttgagtgtctactaaatgctgggaattgtgctaggcgttacagttccaaagacaaaagggcctaatattcttgtagggaaggtggacttacgaacagacgcctgcaaaattaaagagctgatgggcagcaagcaccaagaatgacttgaggaaggtgttggacaggtagtaacactggggctgggacttgaagttattagtaaaagttccttggatgaaaaagttgggggaaatgtatcctattttgaaggaacttcctacttaacttggcaaaacaagagtatgcttttgccttttaaatagcaataaacatggtgtaattggtttaggaaggctgtgctccatggagaagagctggtactacatttaatttatcttgtagcatagtgttttctcaaactatgcttagaagaatactggttcctcgaggtgttgattggtgttgtctggaaatacaaggagcttctgaggccaagtaatgtggcaaacactggggtaggccagttacctggggttaactttccggcaggacttctcagagtctttaatatgctactctgcatcataaattttcaagagcttgccctgtacctatttgtctttcccttttcatagtgctcacagggtttcatggatctcagcatagaaaaggctgctttagggtagaggcagctgccagcagtctttagaaagtgagtgatttctatttcagaaaggtaacactgagcacctgggaaggaaaacgccaaggatgagaaactagacccaaggcaacctataatgaggctgttaaaattttctaggcacaagaaaatgaggctcagaattagggcagtgaaaatgtgagggaagagatagaattgagagatacttaggaggtagaatggatactccataaccacaaggatggtgaatgagagaataaaatagttgaaggtgaatcccaagtttctagctgggaagcttggacagagaagtgttgggtagaagatgaaaaacaatttaatttgggacatacggataaagatggtcaactcatagccagcaactggtgatactaatgaagcaaggtatttccctgacctcttcatgggtgggaactggagtgcatgggtgctagaactagctggccactttggtgctggcacgggtggactccactctcttggtcctgctgtgtttcaccccttgtgggagcggggggagaacaggtgagtgggtgcaggagccagggagagtgcttttgggcactggcaggagctaaactttgtgcaggcccttcagcagcatctaggggagtgcccactacctctaaagcttcagaaggagtgccacagtgctcctttagctttcctgtctgtggatcacttaagtgttaacagctcagtggagggtcagtgtgacagccttttgcacctgcactcgtggcatctgaattcttgtctggtatcctgtagtaatgaggtcgcatgaatgaattggtgatggtaaatgtgggggattttgttggtgaaagtggctggaaggggagctgaaaaggggaaagagcaggaaggtgaacttcccctggagtctggtcatctccagctggactccttccaaggctacactgtcaagctgtccctctgaagtcaagctgcttctctccagtgtccaaccatagtttttcctcatccagcttcttttcctctctctgctggctgagcctggggtttttatggtcacaggatgggggacggggtgggccatgggtggttttgggagaggcaacattcaagagggacaacagggatttttactcccacttttggctgcagtattaggcttttcagcttgaaggtggggccggggacctgccctcttctgcccagagtttccctggctctggtccctatcaataatctgcagttcagggcacagatgaacatatttttatctttctttgatgcttcaagtgactctattatcttgcaatgtcttcaggtcrtcataattaacatcatgttgttgactataaatgtttaacaatgcaggttgtagagagctgtgcttaatagaaagctgaatacaaattattcgttgagatactaacatgtgcctagcacagcaatactacgtaaagaaaaagcaagcaagcaaacaaacaaacaaaaaagggaaaaataaaaagacatatcccttgcttaatttgtttattatcttaagcctagagaaggtattacaagtggtcagaatagcagtgttaagattctgacctttcacttgctatgtgacctagggcaagatacataactttttagtgcttgggttttttcatttgtaaaatattatttgtagattattagtgtctttctcattaaggagttatgaggtttagctagggttaaacaaaaaaaaaaaaagatttacttcattctgaaagtataataaaataaatttctttaggaaataatgtatgcattgtgatctatttaataagttttactgttactttatttggtttccaggtaataccaaataataatgtgtctatttgaattgcaaaaatcaagctggtttgaattaaagaagtgtgaaaaactcctagcttggcaaaatatgtaacacttctatcaattaaaaataggtaaaatgtgttaaaaaataatgaaaagttcatgctttaattgaactggcttttttcaaaagcctatattttttacgaagcttaatgaaacaaaaattgaaatggtgcccattatgaaatctgtgttaattgttattattcccataaagttcacatgactaaaaaaatgcatactacctgcctttcgttttctctgtatttatttttctgtatatcttcaccatggcaaacagagcatttactaaattgaaaacttcctttaaacacactggaaacttttgacacaaaattgctagaattatagggtatttttgtcaatctgacaaaacttccttcattcttcctgatttaaacgcaagactgtttctctacttatctccaatactgtcatcatcttaaatatcgttgtgctggaaggcattgcaatattaattaaaaatacagtctaattatttaccctagttggttcatacaaacctctttggtataatcagtggactcccttaaggggtttcacggtatttcggagtgaaatagaaaggtttgttactgacttggacttggctcatgagtgtaattaagtataacctacaattcacctttaggtcaccagatcaaatacaacttatctgggcaatgtccaaaggtatgtgctgatgttgactgagtgctgacgggcggcatacataaacgaatggaacttttaatttacctccaggcgtctcggagaacattccgggtgtttcagcgagtcagagggaaagcagagggcagccaaagaggtccttcattttagacagtccccaggacaaagcagcacaaaccaagttgaaagagctgctcagatggctgaaggtgtttggcgacaacctcttcccacttctggccttagtgctaacctaaagttgcagggcaacctttgctagctgttggtgttgtgctatgaagcctcctggatgtgcctggggctcagtcattggagagattgccttctcaaggaaagcagtgaagtgtttccaggtccagcacagtgctcagatccaggcttcaaaactatgtccttgggctcatctggcataacaggggttcaattgatttctcaaggagtcttaaagcgtccatttgtctttctcacaaatatgttttagaaaaagtgacaataaggccaggtgcagtggctcaggcctgtaattccagaactttgtaaggctgaggtgggtgcattgcttgagccccacagtttgagaccagcctggacaacagagtgaaaccccatctctcatatatatatatgtaaaatatttaatttgtatatataattataatatattatatatatttaatatgtataataaatataatggcagcatgtgcctgtagtcctagctactcaagaacctgaggtgggaggatcgcttgagcctggaaggtggaggttgcagtgagctgagatcaagccactgcattccagcctgggcaactgagcaagaccctgtctcaaagaaaaaataaataaaggaataaaatgctctcgactcccattttaagataaaaatcagtgtctgaaagccctactcagtttgaaacattgaattgcctggcctaaggaagaagagaagttcacaagcagccccataaggtgataaaagagtttggcaaatggaaaacagcagtacaaataaaataatcttcagttctaaatattgaaatcgattagaaattatagtggctagggccaggcatgatgtcttacgcctgtaatctcagcactttgggaggctgaagtgggcggatcacttgaggccaggaattcaagaccagcctggccaacatggcaaaaccccgtctctactaaaaatacaaaaattagccgggcgtggtgatgcacacctgtaatcccagctacttgggaggctgaggcacaagaattgaacccggaggcagacgttgcagtgagcagagatcatgccactgtactcaagcctgggcgacagagcaagactctgttttaacaaaaacaaaaagaaattacagtggctgaactgtaaatttattggtggatattgtgggaaatgagaagaaaatggtagtttaggctagatatggaaggctttgactatctcgagtgttttttttttttttaaatatccaaagccggtggtgtagttttacctgcataaccaactcaacaggaagatttcgattaatctagaattgagtgggaataggtattttgtatgatttttcctaattgaatacaacctaaaattttggctaagttaagagttccaggaagaaatggatgaatcaggtgtttgcagtcaggaaggtaattcaagacgctgaagttttgtgaggaagatagtagatggtgtctcccctgaggtgatctgtgaagaggaaaaagaataaagcaaccagagattgtggcctttgggtttctgcctgctgagaaatgacagatagaatcccagccagctggaagctctgattcacagaaacaggagaggtcatgtgagatataaagtcaaacagggctacatgcatagttgctaagttttattttaaaacttgttaatcttgttattgggggattggactggacttcggtggaatctgctagaaagcattataaaacaaatcacatctgttcctgcaaataagctgtccatccacccattcccttaaaaatatttattgaactcctactatgtgctagttatgagataaacaaaagcagacagccccctgacctcatggagcttacagtcaaatgaagtgcccaaggacttggatacagtgggaatgtgagcagagtgagaggtgcagagaagaggtggacaatggccaggccatacaggcccctggagggcagggaaactattttatttttaatattaaaggaaaggaggacccattgaatacttaaaaaaawttttttttcattttattttgaagtggagtctcgctctgtcgctcaggctggagtgcagtggtgcgatctcagctcactgcaacctccacctcctgggttcaagtgattctcctgcctcagcctcccgtgtagctgggactataggctcatgccaccatgccttgctaatttttgtacttttttttagtagagacagggtttgctatgctggccaggctggttttgaactccggacctcaagtgatctgcctgcctcggcctcccacattgagaacttttaagcagggaaattatatgatcagtcagactagcttctaggatttttttttcctcctgcatcttcatgggatttttttgatgcccaatttctccccgctgaccatgtagatgcagttttctaatgacctcagaaaattgactagggcgtgaaagctgttgtgttgatgaactgcagaagtggagaaggatgaagagaccatgttttccagtttagttcggacactcaccaccttaccactggatcgcacagtagcttcattagttggcctgggtctgatgcttgcctttcctgccagaaaaattttctcaaacaattgctcatggcatggccctatccagaacctccaccagggccctagggccacagtgccagagcatcttaccagagcaacccaggtcatccatggaatggttcctgttggtcttctatgtgttattggccataaagtttgcaaagcatcacttcttttttttttctctctctctctctctatatataaaatactttaagttctagggtacatgtgcacaacgtgcaggtttgttacatatgtatacatgtgccatgttggtgtgctgtacccattaactcatcatttaacattaggtatatctcctaatgctctctctcccccctcccccccactccacaacaggccccggtgtgtgatgttccccttcctgtgtccaaaagttctcattgttcaattcccacctctgagtgagaacgtgcrgtgtttgattttttgtctttgcaatagtttgctgagaatgatggtttccagcttcatccatgtctctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttataggagcatgatgtatattcttttgggtatatacccagtaatgggatggctgggtcaaatggtatttccagttctagatccctgaggaatcgccacactgttttccacaatggttgaactactttacagtcccaccaacagtgtaaaagtgttcctatttctccacatcctctccagcacctgttgtgtcctgactttttaatgatcgccattctaactggtgtgagatggtatctcatagtggttttgatttgcatttctctgatggccagtgatgatgagcattttttcatgtgtctgttggctgcataaatgtcttcttttgagaagtgtctgttcatatacttcacccattttttgatagggttgtttgtttttttcttgtacatttctttgagttctttatagattctggatattagccttttgtcagatgagtagattgcaaaaattttctgccattctgtaggttgcctgttcactctgattgtagtttcttttgctgtgcagaagctctttagtttaattagatcccattggtcaattttggcttttgttgccattgcttttagacatgaagttcttgcccatgcctatgtcctgaatggtattgcctaggttttcttctagggtttttatggttttaggtctaacatttaagtctttaatccatcttgaattaatttttgtataaggtgtaaggaagggatcccgtttcagctttctccatatggctagccagttttcccagcaccatttgttaaatagggaatcctttccccatttcttgtttttgttaagtttgtcaaagatcagatagttgtaggtgtgtggtattatttctgagggctctgttctgttccattggtctatatctctgtttttggtaccagtaccatgctgttttggttactgtagccttgtagtatagtttgaagtcaggtagcatgatgcctccagctttgttctttggcttaggattgacttggcaatgcgggctcttttttggttccatatgaactttaaagtagttttttccaattctgtgaagaaagtcattggtagcttgatggggatggcattgaatctataaattactttgggcagtatggccattttcacaatattgattcttcctatccatgagcatagaatgttcttccatttttttgtgtcctcttttattttgttgagcagtggttggtttgtagttctccttgaagaggtccttcacatcccttgtaagttggattcccaggtattttattctctttgaagcaattgtgaatgggagttcactcatgatttggctctctgtttgttattggtgtgtaagaatgcttgtgatttttgcacattgattttgtatcctgagactttgctggagttgcttatcagcttaaggagattttgggctgagacgatggggatttctagatatacaatcatgtcatctgcaaacagggacaatttgacttcctcttttcctaattgaataccctttattaaaacatcacttcttaaactcgttcagtggattgccagtttaatgagatgttcacagtttctccattaaaaaaaattggcttagtttgatagctcacacctgtaatcccagcactttgggaggccgaggcaggtggatcacatgaggtcaggggtttgagaccagcctggccaacatggtgaaaccctgtctctactaaaaaatatataaaaaattaggtgggcgtggtggtgcaggcctatagtcccagctgaaggactggaggctgaagcacaagaatctctcgaacgtgggaggcagaggttacagtgagccaagatcatgccactgcactcaagcctgggcgacagaacgagactccatctcaaaacaaaaaaaacaaaaaacaaatcaaagcaaaagaggcaggggagtctattagtcaaatacatcaggaaaacaaacccaatgtataatatcctcactcttcatgaggcacttaatgtacttagcctcactaaaggctccaagaagtcctgcaaaaatgtgattaactcaacacttaccaagcatgatcaatgttaaacccttttctgcacctaaccatggttaccttgttgaacagtttggaaaacactgccccagtttaacctctttgaacttctcttgccatggctctgtttatgctgtttctccctttctgatgcccagtttggatggccttttggattctccttttgggaaaaatcgtcattatcccctctatcttttcaagctcatccaacagagatgtcacctgctttatgaagcccactctgatgatcctaactcagactgacattgcttttcctctaactcttgaagcacttttttttagctgggctatttggtgttcctttactactactttctggtgttcctttcaccatttatgtttataatggcattcttttcatctttactatgcaaaaaccagctttaaaatttcttgaagggattgatggttctaatttttaggttggaaggcagaattgtgaagaaacatgagctttggatcaagacagttatttcagtcacattttggttaaccagctgcatgactttgggcgaattacccaacttcactaagttttagctttcttatatctgtaaaatggggacaatgaactccctacctcttagaggtgttgcgaagagtaaatgagactatgtacagtgtctaatgtattggaagcaatcatacatgtcagctgctgtcattattatcacatcagtggctaagaatgcgacacaaaaaggtcccttttttgttataatgactgtacatgcccaatattctgggcaatcaaaattcctcaatattccaaatattttggcatccaaagaggctccctctctctttgcaaaggcagagagaggtatgttagatgtatccattgtctagcaaaraatggtcttcctcccagagagagaaagcctgttgctgtgactgccacattccctgcattttctggtccatccagattgtaatagtgaatttcacaagcaaacacatagtccaaagcattctgacttctggttcaatataagtgctgtgtctttttttttttttttctggagacagagtctcactctggagtgcagtggtgctatcctggctcactgcaacctccgcctcctgggttcaagtgattctcctgcctcagcttcccgagtggctggacttacaggcatgcaccaccatggccagttaatttttaaaatttgttttaatttttttagtagagacagggttttaccatgttggccaggctggtcttgaactcctggcctcaagtgatctgcctgcctcagcctcccaaagtgctgggattacaggcgtgagccactgcacctggccaagtgctgtatcttgcatgaagaggtacttggcccctgcctgtggctagcgtgtccacctggtatacctgacctggacatcaggggacatgcaggtgtaagtcagtggctgggcagattcagccctttagttaatttaggttaaatttcacttgaatccatgtgattgtttatactaagatagttcagcaaaataaaatgtcgagtccttttatattttacatgataaatatatatgaatcaaggaaaaagaacttctgtttatttactaaacgtttatcgagtgcctactatttaccgggcacagttatatgcagttgttatacaacagtatacaaaatacagacaaccctgttgtaatggagctgaattctgatgggagaagaaagaaatcaaacaagggaatgaactaatatattatataacaaatggtagtaagtgacgtgaaaaaattaaagtaggacatggaagacagagagttgggaaagtcagggaaatcctttctgttacaatgacatttgagcacagatgtgaagaagaatctgggaagtacttgggctaaggaaattctcaaaaggtaaaggatcatgtcgcctgatagggaagagaaggcagctgagataaagaaaaagagtggtttgaagctcgctaaaaaacatgccagattttgtggccaagtcaacaagtcttttatctgcaaaggaattcaaaagccattggtgggtttgaaggagaggcactacatttgtgtttttggaagattactctggcagtgccaggtggagaatgggttgagggagtgaagtagatccagaggaagaggaagagggaggagctcaggtgactgatgggtgctgttgtttccagggtggccatgctggaagaggagcaggcttgctgagaaagatgctcacttaggtcagttctggaagggcaatgttggggcggtccaagagagagtctctccaatgcagatgggagcagtcagttgaagtaaaacctccctggagaggttatttttttattttttatttttatttatttattttttgacggagtttctctcttgttgcccaggctggcgtgcaatggcgccatctcagctcaccgcaacctccacttcctgggttcaagtgattctcctgccttcgcctcctgagtagctgggattacaggtgtgcaccaccatgcccggctaatttttgtatttttagtagagacgggtttttgtcatgttggccaggctggtctcgaactcctgacctcaggtgattcacctgcctcagcctcccagagtgctgggattacaggcgtgggcctctgcgcccagcccctggagaggttttaaagctggtggctcatggatggtgactggggccatgatgggagtgcatggaattatcagggagctccttagagtgagaaagaagaggaccgaaaatagagacgtaggaaggctgaagatctaagacctgaaggaggggccagaaaggaggccagaagacaccccggagcctgtgaaaacctggaggctgcccaccagatagcatgatgatcaagactacaggttctggtgtccaacccacctggctttgaatcctgacttccccactaaaactgacatgactttcggtactaagccttgcagggtgattgggagggattacatgtaccatgtttaaaatctttagcactttgtctggcttgtagtaggtgctcagtaaagtggtacatgtggaaggggatatggagaggcacatggatggaaatggagatggagagagagacggaggtattctctaaaaatgttcaactcgaagtccttggcagcattaacagaaggagtggcagcatctcagctagcatgccagaataggatctgctgtaactctacacagcccagagcctgtcatgccctcgggtaatgtaatgaaaggtgttttcctctcttcagaacaggtgctccactgatacaatttagagtctcaaattccagagcttaattgtttgttctacatacaagttagcccagctcagaacacctgtgggctaagttcttttgatgcaccaaagcctgtcttttattaagcyctttgcgagcagtcaaaataagaccaaatgtccatgtgtcgctgcgtaaccatgtggacatgaaacaagccagccagcgtgaggagtgcacagtaagtgcttaaaatagcaagtgaatccttaggctctggaaaatatggttacgtgattaatgtaaccagagttagagatgaaataacattaaatattttatatatatagaaacttgcctacacacacataaaattccctattagttgtagttgaggtttagtsatgttgaatcgataaaaaatgatttagagcggatggtttcaaaagctggttgtgctttcagtcttccataaagaagttaaaattaattttaatatgttgatggtgcttattgatgataatattcataataaatatccatcggaaaaattctccggcacatctgtgtgacagagaggtcaagaatgttaatgacgatcaggactacaaaatgcaatccagtcaattactttaattaaatctaaaactactttatgtcttctcatttatgtagtaaactgatagtggagaaaagggcaccatctttatctggctcattgtagagtccaaagatgcggtctcagattgttttaacatttgtagctcttatatccttgtggaatatttaaagtatttatgggtcttatgagtaatgctcctgcttctgtaagaagaagaaaaggtggagattttcctttgaatgccgttttgtagaaggagagctttcttttcacagacactaatcttgtatttacagactgggttatatttggtagagccaacattccagggtaaatggtagaaacgtctacatttcagtgaatcctttttaattatattgtttgggatcagaagaaaaagaacacagctgtctgaagttctccctaccacagaggttcaagtgcttataacccagtcatcatagcctgcaaaatgcctttttattaattgtggtatcatacaaaagttggcatcacctatgtgtttcggttattaaacttggagaatagaaaggtgagcattttagaaaatgaatcaattaatgaatgagcaattcagtcagtttttccatgaatattaacagcatgtagtgcctactgtgtgtcatgtggtgttacaggcatctgaacacagctgtaaaccacacagagaagatccagtctggacctcaaggggttcccattttagcttgaaggaaatgaggaarcaacaaaaaaagtaaactgaattttatcagataaggcaaaaactatgccaaaaaacccmcaaacaaacaccaaagcaggatgatgataggttgaccagcttttcctagtttgcccagggctgccctggtgttagcacagaaaatcttgtgtcccaggtaagccctcagtcctaggcaaactgggttgattggccatcttagtaatgggaaagagagcagctaaatgagaatttattttggatgagtggtcagggaaggcctctctggggaggtgatacttgagttgagataagagcaatgcggggacccagagctcacactggtaatcccagcactttgggaggctgtagtgggaggatcgcttgagctcaggagtttgagaccagcctgggcagcttggagaaaccttgtctctaccgaaaaaaaaaaaaaagtagccaggcatggtggtgcacacctctagtcccagctactcgggaggctaaggtgggaggatcccctgagccaggagaggtcaaggctgcagtgagctgtgatagcaccaatgtgctccagcctgggtgacagaataaaaccttgtctcaaataaagaaataaataaataaatggagcaatacaaaggagctgccttcatatacctgcagatccctcaggatgaggttcatctcctggtgatctttcaaaagaatagattygtgctttgagaagaagaataaacatttatgaaaagttttctrtgagccaaacagtgtaaatatgttatctcatttaattcctacagccccaagtggtaggtaggcattagtttttccattttacatgttagacattaagtgataaataatgtctgaagtcttgagcctaatagaaaatggcaataagatctttctctgcttgaattcaaagcccacaggagggagtgtgaaaagtgagtttaagtacttttgggaagaagaaccactttctgcttggagaagagatgaaaatggatccttcatttatggagcccaagctcttgcygtacagcccctgaaasctcctctaagtgggattggcttggacattatcctttaaccactctagatctgacagccactgggctaagcagcctctttaagatacctcttaaagaactcaggactgcttgtggaaacagaaaaaactatggtgatgggaattggagtttctgcaaatcacagataagagggaatgagtgtaaatttttagcattactatggtcctactgtatctctgggttagtgttgcctatgggtgaatgagaggcgtgtatctttgtcttataatttagcttctgggatgtgtgtgttctttaaatcttagagaagacctcatgtatcatgtctttggattttccattgcagctaacacagatgcttgcatgtagaatgaaattcataatatttgttgaaattcaaatatttggagagtcagcattggcatactggcgaagttcagtttttgcattcaaagtgatttttataagacagtctctgaggtgactcactcctgggtttgactaaaagctattttgggcttttaaaaaaaattccttgccatagttttatatatacatatatatatatatatataactatatataaaaatatataaaactatatatataactctctatataaaactatatatatataaaactatatatatatataaacttattctttaaaagacaaggtctcactctgtggtccaggctggagtgccatggtgtgatcacagtgctcattgtaaccttaaactcctaggttcaggtgatcctcctggcttagcttccgaagtagctgggactacaggtgtgcacctccatatctggctaattaaaaaaaaatttttttttgtagagatgaaggcttcactttgttacccaggctgctctcaaactcctggcctcaagcacttggattacaggtgtgagccatcgtgcccagtaccatagttatattttggcccaactcatgctatgatgacaaactctgaaggtataaacttatttagcttaaaatacaaagatgtgagaaagcacttttggaatggtagagtgaggacattaaaaaaaatacataccacttcctcataaaagcaataagagtactggaaaaatagttaaaagcaactttttcagaactctgaaaattaatcaaaggttttcagtaacttgaagagtgttgattcaagaaaggtggctgaatcttggtaagaataataagtgttgtgatgttttaacttgccctagtcccattccactctctccagttctgtagtaatattgaaaactaacagcctcacaattatggtagtcctgaatgtaagcagcctagcagctactgaaggggagaagttccatctccagaaaactttcactgtttgacctgtctcacagcttgtctttgatatgactcagactttactctgtacaaatagccttttgctaaactatttgttgaaaacagtcagtggcaattatttaatgtggcagctacctgaggtgataataacagatgaggctaccaagaggctgagcaaaacatttaaaaaggaaaaactgaagaatgatatgagcatagaaggttttgaagagctccaacatattcccaggaatctagaagtccacgtgcaagttcggggctatgcacctgctccagaaagatccgaggaggttctgagttctcatctgtgactaacctgaagtttctgtgtaagcaggaagtgaaggcataggcagaattctcaatgacctgactgagcattgtagatgccctcccctcttccagaacttcttactgaagcctaggggactcattgtttcaagtcatttaagaaaatctctggggtgagtgtggtggctcgtgactacaatcctacccttttggaggctgaggcaggaggatcacttgagcttaggagtgtgagaccagcctggacaacatggtgagatcctgtgtcaaaaaaaaaaattaaaaaaattatgcccctgtggtcccacctatttgggaggctaggcaggaggatcacctgagcccagcaagttgaggttgaggtgagctgtatttgtaccttgtctcaaaaaaaaaaaaaaagaaaagaaaagaaaagaaaaccctctgtctgagcattagctaagcacagagtttctaaacagagactttagtggctgtacatgaccaagactacaaatgttacagaattagtttgaaaaagtcactgaacaaacagcagcaacaacaataaactttaagagtaacaaatcttgaaggaatcttctttccagaatagccacattatataattttatatatatatatttttataattttattttatattttatttacattttatattatatatatgtccagttttcaaaaaatatgcatgagctacacaaggaaacaggaaaaattccagatgttggaattactatacaaaaactttaagtcagctactattaataagttgaaaaaaggaaagaaaaacatatttagagaattaaagcatgaaaataatacttcaccaaataaagaatttcaatgaatagatagaaattataaaaaagaaaaatagagatctaaaatgaaaaaatacaatcattgaaataaaaatttgctagagttgcctaatagcagatacgaactgacagaagaaagaatcagtgatcctgaacatagttcaactgagattatccagattcgggaagaaaaagaaaaaagaaatgaataaaaatgaatctatgggacgctagtgtactaaaatatatgtaataatcacagaagaagaggagagaagaaaagttgaaagtatatttgagaaaataatggctgaaaacttcccaagcttgataaaaaacgttaacctgtacattcaaaaattttaaaaaactccaagtaaacttaacacaaattgatccacacctggatacattataaactatcaagacagagaaaatcttgaaagcagcaaaagaatcatagagtccaccataagatttaacagttgacttctggtaaaaacccaagaatatcaaaaggctactgtttacatattcaaaaggatgatagaaagactattcatcaagacttctatattaaatgaaacttttctccaaatataaaggataaataaaatcatttccagagtaggaaaaactgagagattgttactagcagacctgccctacaagaactattaaagagagagtccttcaggctgaaatgaaaagacattagagagtaactggtaaatgtactacataggtaaataaaaatatagcataaatgtattttgtttgtaaatcatttattctcttatttaaacacctacttcataaagcaagaattataaaactgtgtttatgggcttacactgtgtaaagatacaagttaattgacaaaatttcacaaaggagagagaagaaatggagctatatggaaacaaaattttagtacactattgaaattaagtcggtagtaatttgaactaaattgttctaaattgggatgttgatcataatgtatggggcaaccactaagaaaataaaaaaaaaaaaaagtaaaacaaacagcaaggacattaaaacaatatactatatmatatgtatttaacataaaataaggcaataatggatgaacagaggaatcaaatatggtagaagatatatagaaaataaatagcgaagtggaagataaaaacttaccttatttgtaattacttaatagaaatgtattaaccactccartgaaaaggcagagattggcaaaatggacaaaaaacataatccagctctatgctgtctacaagagacaaactttagattcaaagacacaaattcattgaaagttaaaggatggaaacatactaggcaaacagtaaccaaaagagaactggagtggctctcttgaagacgaaatagacttcaagacaaaaagtgttactaaagacaaagatagacattttataataataaaagggtcaatccatctgaaagactttaaaattaaaacacatatgtacccaacctgacaagagagaaataaaactgtctttgaagatgacgtgatcttgttcacagaaaatctcaaggaatttattaaaaatttattagtgctaattgttgagtttagcaaggttgcagaatacaagatcgatatatcaatatgtgataaaatcaataaattctatttctatacactagcaatgaacaagttgaaaatggaattaagacaacaattctattttaacagtatcaaaaagaataaaatatttatgaataaatttaacaaagaagtgcaaaatgtttacactaacaactgcccaatattattgaaagaaattttaaaagacctaaataattggcaaaacatcccatgttaatgatttggaagacttgatattgttcagatggcaatactcccccaagtgatccacagattcaagacattccctttcaaaatcttagttgcttccccgctctgcattaaactactagttggtcctaaaatttaaatagaaatgcaagggatccagaatatacaaaacaagaaaccttgaaaaagaacaaaattaggggactaacatttctcaacttgaaaatttaggtacagtaattaagatagtgtggttctggcataagggtagatatttagatcaatggaacaaaatggaagattcagaaataacccttacatgttccgtgagttaatttttgactagggtggcaagtcaatggaggaaagaataatcccccaaaatgatgccagaacaattggaaatccacttgtaagagtaaatttagatactctatcccgcatcatatccaagaattacctcaaaatggatcatagacctaaaggtaagtgccaaaactgtaaaactgaattaggcaatggtttcctagatggcactaaaagcaaaagcaacaatagaaaaaaaataggtatatttgactttatttttatttttaattttttttttgagacagrgtcttactctgtcaaccagactggactgcagtggcacgattatagctcactgcagcctcaacctcctgggctcaagtaatcctcccacctcagcctcttcattagctgggaccacaggtgtgccaccagtcctggctaattattttattttattttgtagaggtgaagtctcactttgttgctcaggctagtttcaaactcctggcctgaagtgatctggccacctctgcctcacaaaatgctaggattacaggaatgagccactgcgcctggcctaatttgactttattaagcataacaaaaaaagctgctgtgcttcagaacaccaccaaaaggtaaaaacagattggcatgtggtttatgcctgtaatcccaacacttaggtaggctgaggcaggctgattgcttgagcccaggagttggagaccatgggcaacatggcgaaacgccctctctgcaaaaaaatacaaaaaattaactgggcatggtggtgtgcgcctgttgtcccagttacctggtatgctgaggttggaggatcacctgaggctgcagtgagctgtgatcacaccatgcatttcagcctgggtgacagagtgagaacctagttcgaaaaaaaaaaaaaaaagtaaaaacacaatccactgaacatgacagaatattttcaaatcatatatctaagaagagacttgtataaagaatatacaaagtgctcttacaactgaataataggccgggcgcggtggctcatgcctgtaatcccagcactttgagaggccgaggcgggccgatcacctgaggttgggagtttgagaccagcctgatcatcatggaaaaaccccacttctactaaaaatacaaaattagccgggcatggtggcacatgaggttgtggtgagctgagatcgtgccmttgcactccagcctgggcaacaagagcaaaactccatctcaaaaaaaaaaaaaaaaaaacaaaactgaataataaaaagacaaatatgtaattaaaaatgggcaaaggatttgaataagcattttttttctgaagaagatatacaaatgggcataartacatgaaaagatggtttatatcattagtctctaggaaaatgcaaatcaaaaccacaatgagattcgtgacacacccattagaatggctaaaatttaaaaagacagacaataacaagtgttggtgagcatgcagagaaattggaaccctcatactttattggtggaatggtgaaatgctgcaacctctatagaaaacagttttgcagtttctcaaaatgttaaagatagaattaccatatgatctagtaattccatgattaagtataaatccagaagacttgaaaacatatgtccacacacaaacttcttcaagaatgttcttagctgcattccttataatagccaaaaagtggaagtagcccaaatgttcatcaactgattatttgaaacacaaaatgcaatatatccatacaatggatattatctggtcataaaaatgaatgaagtacagtattaatgcacgctacaacacagatgaaccttgaaagtgttatgctgggcgaaagacgccagacaccaaaacccctgcattgtatgattccatttgtatgaaatgtctaatgcaagcaagttcatagagacagaaggtagattagtggttgtcaggagcraggagaggttagaatagagagtgattgctaatggacatgggatttatttttgaggtgttgaaaatgttctgaaattagatagtggtgatgtttatataactgtggatttactaaaaactgctgaattgtacactttaagaggacacattttatggtatgtaaattatatctcaataatgctgttataaaatctagtaatatgctttgtaggaaaatgtgtataaaaataaacatcttggtagataagtttttataaggtaaaaaaacagaggcaggcgttcagattttccygctaatatctcattttctcttgtctgttttagatgagtgtaaggccattatcatggactttttccccagctgcaggtaggtgtacccatttgactgaattctggcctatagggtaagaacgaaatgtcttgtgaaactgctctgttgtacccttgaaagaaaattgctggctgtctatgtcctccttcccattttaggcaggctgaagtgtgcagatgaggggttgagccattgtttttttgtttttgtttttgtttttttgagacagggtctcactctgactccccaggctggcatgcagtggcatgtttgtctttctttctaaaacaaattattcttttacaaaattaaataatttaaaattatttttaatgctaaaaatattgtgcatgcaatggtgtacattcccctcccaggctcaagcaatcctcccacctcagcctcccaaaatgataggattacaggaatgagccagtgtgcctggctgccatctttgaactggttgttaagagcaatgccgttgggagctgggatgctgggccacttgatgagcagagcctacagaatcactctaatgccaaagagaaatacattctctaccagatattggccattgttatttttgccacttttaaagcagtcaaaccaatcttctcacttatagaataacrtctttggggtcatgatatatattttttaagatttattgttccttcccatgaatctatgttcagatggttccaaatgaaaaactctgagggtatcaggacacatacgaccagtcccgatcttctggacgtttaaagtaggagctgtctgcataaatagcaaatagaaaacacaatttgaaacacaagagcagagtttcaaatggacttttgtggaagtgtagttcaagttgaggggaacaaaagaggactggaggaagatgtagaagagtaaggtgacctgagccaccccttggatggttaggtggagagcttcagcaggtggaagggtgtggccaggggggaacagaagagaggtgagtgcagtagacattagccaaggtcagaatatagcagagtgaccaaaggggaaaatggttggagattatgctgagctcttcaagttgactggtgctgcagataattggattgaagctcaggacagatgtccaagtgagaaatttaagtttgggaatcatctgcagagatggtggttgaagaattgggaagggctaaaacttcaaaatcatatggcttgttctatcatcaggattagccttctctaattccctgtgtgctctttgtctttctaaaacaaattattcatttaaaaattaattttacggtggctcacacctgtaatcccagcactttgggaggccgaggtgggcagatcatgaggtcaagagactgagaccatcctggccaacatgatgaaacccagtcaatacttaaaaaaattaattttaaattatttttaatgttaataattttttaaaaaggaaaactggtaaaaatttcacttatatgtattaattacaaaacaactctaccttatcaggatacaaaaacactgttaagaaaatataaattggatggccaggcatggtgrctaacacctataatcctagcaatttgggaggctgaggtgggagaattgcttgagcacaggaattcaagaccagcctgggtaacataacaggactctatttctacaaaaatccaaaaattagctgggcaaggtggcacacacctgtggtcccagttgctccagaggctgagatgggaggattgcttgagcctgggggggtggggtggggtggagggtcaaggcagcagtgagccatgctcataccagtgcactcagcctgggtgacagaactggaccctgtctcaaaaaataatacttataaattggaataagaaattatgttgcctttacacacctgcaaatggttttcctaaggagttagttgaaaaattatactttgcttttctccaggaatatttacttataattttccctgtgccaatttggcaccataatgtgaatacaatacaatacaatacaatacaatacaatacaatacaatacaatacaatacaatacaatacggtacggtacggtacggtacggtacggtacggtacggtacggtacaatacaatacagtatagtacagtacagtacagtacagtacagtacaatacaatacagtacaatataatacagtacagtacaatacaatacaatatgttaatacatatcattttaaaggtaaattagttattatcaaattgtttttatttttaaacaattttagagttacagagatattcaaaatagtacagagaagtcctatacacttttcacccagcttgcccttaagttaacttcttacccacaagcgtgattctgagaaattaactacaattaagcataatactattaactaaactccagactttatcagatttcaccagtttttcttctaattgtttgtgtgtgtgtgtgtgtgtgtgtgtgtgtgtgtgtgtgtgtgtgtccaggatccagtcaccgatctaaaattgctggtagtctttaagttttaaaatcctccttagtcatttaaaaacatggtagtacagaacattcgctctagtccatctgaagcaaaggagactggaaggggaactatgaactgcctgtttgagaccaggattagttatgaataaaaccctagacctgtcaagtggatggttgtgggaatcaaacatgaaagcactctgaaaattatcaagtatttcacyccagtaagatcatttattcattcatcaatttttcagaaactatttcctcagcaccagtcatatcttaggcaccatgttcggcaggggaatcacacaaaaaagatgccggttcttgcttgccggtaattctagccatggaaagctgatcattaagtatttattgaatgtctaccactggccctacgataccaattattacctttcccttagagtgcactcaatgactgttccattacaggcttgaaagagttaatgtgctgcaaatgcctctgtgcctggggagttctgcaccacctctgcccaggctgcagaggcattaggctccaagtatgtattttcttttcccttctgtttatgtctctgttttctgtaaagtctgctaaaccgcagcagtatcttccaagttctctgacaatgttataaatttcattaagaagatgaagccttctggggcaattaactccaaaagtggtacaaagccatagcaaggagatactggcctgtagtacttagcactcagctctgaaatggagataagccctatcaacccggggttgtgtttaatgttcactgcagcttccataccaccgctacaagctagcggtcaccgtgttaacactccccaatatctattacaattagtttttgattaagaggcctaacatggcttttgaagctttttatgttgtgtcaaatggctagtgatggagtgagatgcacagacacctcccggtaacaaagcatattgtaaaaggtttcgagtgaactattttatcatcctaatggaaaccagatgactcgaactccccccttaatttcaactatttactgaagagtccttgttttgaattactgaaagatttattcctatatgactacctcatgcattaagaatcgctaataacagagccatttggaatttgggaaagcttttaaaaatgactgaagcaatgttcacagaggatttattttattttattttattattttatttttcatttgatttttaaagagcaaatgattttgccctttcctagtatttaattattcctttagttattgtttatgacgcctttctctgttgagttatactgtctctgccagggtttcagtcagtagtcttggcctgctgtctaagaaagaggtcactggtatcttgtgaggagagaaaactttgttcagttatgtaagatataattctttgtgaactgaaactatatgctatttttgtaaaggtccatttgatgaaacaaagtataattattttaaaatccctttatagattaaaaagctgaagatctgaattgtttgacattttattactcttaacatgaacrgtcacatgtaaatgtaatgaaagtggtatagaaatatgacttaacttgtgagtgtgaatcgtaagagctttttacggccgggcgcagtggctcacgcctgtaatcccagcactttggggggccgaggcaggcggatcacgaggtcaggagattgagaccatcctggctaacacgrtgaaaccctgtctctactaaaaatacagaaaaaattagccaggggtggtggtgggcacctgtagtcacagctacttgggaggctgaggcaggagaatggcgtgaacccgggtggcagagattgcagtgagccaagatcgcgccactgcactccagcctgggygrcagagcgagactccatctcaaaaaaaaaaaaaaaaaagagctttttactaacatacttttttactgactctctggcctcattcatacatttccctttgaacctcagtttcctcatctgtgatctgggggttgaatagacgtgccctgagtttttgttcatctccggatgttattgactctgtgacatcagatgtgctggagactgttagtgcctggagcgtaaaggttttatcacggggacacagtatggtgtattgggttcaaaccctggctctgcctgttactracctgtcattctttggcgtaatactaacttattaatgcttagagtccttccatgcaaaataaggacaatgttagctatttcacaggtgacatgaaataacctaggaaataaaatcagatatatagggtgcctgataaatggtagcctctcaatcatttccgtttccccctttttgccttcacgttttgtcctgtttaatggtgccttgtacaactggaatgaatgaaatgaccacgatgtttgtcatggacctccttatattacaaacacttagtgagcacttgctatgtgccaatgttgtgctaggtctggggatcctaagactagaggcagaggcttgctcatacaaagattgggtcatagacagtaggcagagggtttcaatagagccagacagtcagaaatgagtagagatggcagctgtcaggagggccgcccactcagtgcagattgcagttggggctcactctcgtatatgatcacatacatcatttcaggtagtcttctcaaccaccccctcggcctagcaaggcasgtgttatcaatctcccctttgtagattaaaaagctgaagatctgaattgtttgatatkttattactcttattaataagatccattcaaaataaaacttgctgtcacraatgtaattgcagcgaacatgtgcaaagatttagaccaagtaaaaaaagctgtagtagatttacacattcatatttcacttatcagagtctgttttctaagcattatcgcttggagccccattcatttcattcatttatgcattcgtccagcattaatacactgttttccaagcacagggctaggtggtgggggtttgaagatgaaagcrgtagcctctgcgttcagcaaggaatttgcagtcctgtgaggtgataggcacttgcacccatgattatagtgagaagtagctgctggcccagaggktgacagaggtatttgagggaacacaagggaaaggccccctgaggtggcttagatgaggccttctggaagaggggaggggacaattgaacttagctgaattttataggattcaaaagggacaagygaaagtaagggtgacatggagatactcgaggtgaagagagtctgggagacaggagaaagcatggctctctggggctgttgtcagtggtgacaaggtaccgtgtggtggggatgtggctgtggagaagtggagaggcaccaggttatgaggacatttggccaacactcgtccttcagcaagaaacaagttcccatatacactttgtagttcacatctgttgaagtctacccacatttaactagtaaacaagccttgtatcttatttctttccatttcctcttgaacccatctcgtttgctgcctgtggctagtctgggttgatagtccaccttagcggttggttagaggctgctattagtatgaccagccttaaataatttgattttcaggttgggtaagtcacartatctcctgtgggcttgatagtcaagctacacatttatttaaaaattggtttcttcacattatatttgaaagcagtgctactcattcatctgtaaaccattaggctacatgtataacagtatctcatctgacttttatctacggagttccgaggatccgtttcaggtccttgcggatattccagttctctatgaagtctattgtcttattttattagttttctctttaggacaatcctatagtgaactgtgtatttaaaggagaagagaaaccgttgaataaattgtaragatacactcagactttcctcctcattggcaaattttcgggcgttcttttttgtttgtttatttatttgtttttaatttaaacaggagatttaaactggcctggtgtggcctgcagtagataacgtattgtttggcccatgagttataaatctagagatttcacacaaaatatggcttctttaaaaaatcaaaagatatgatgctgtggctcttaggggctcgctgtggggctaaggcacattcactcccaggttcctcagggtgcctggggcacccacttcactcaccaggattccctgccacatccccaacacctttgccttcctgtctacagcttggacttgaccttttcccattaaaaaactgggtgaatgccaatcagcaggtacaaaatgtaaccctcttagcgcagaagttttaaaacaaggcatggacttaataactcaatgaggaagcaaatacttttacagaggctttgcaggttagtgataaaataaatttcctgagtgattttacccattgccatggaaggaaaacaagggaaccacaaatgttagactaagtacaatttaccagatcaatgatcgtccagaaaattccctccatccttgcacttacttcctatcatgactgtctcagaactgttttttggtgagaatatgagaaatgtaaaaatgaagaagtaattttctcactctctaacaatcagaaatcaccactggggttttcttatatttttcggggggttcctctggcacccactttcctgagcttggttggaagtgctagcttttcctggtgttaattattaatgtgacctgtttatgtaccagttatccggctaaccattaatatctgtttactcattgatgacctttgcaattgcgtacctagctcctggctgtaaatgtcaactttttgtttttatatgctaaatgttttctctatatctactgagtacctgaaacaactccttaacaaggtaaaataatatcaagccacacaaatataacctttatgaatatgaaaaggaagacaagttccttttcaagctattttttctgaggsctcagacaagctattttttctgaggcaacagaactttcctgtttggaatgagcaagagatgtacacaaatggcaaatgcgaaggatccctgagggggaaaaaaaaaaaaaaacaattggcaagaaaaaatgttcttctgctctctgcttagtttggggaggcggggtcgggggcaggggcagggacaagtaaaggactctgacctaatcctggggaatgaaacccaattttactttttcaaaatgtcagtgttaagcacttgcacattcaagcaggcctgcaggattgatctccagctacccagtcagtccacattaaccccaacacgaggaagacatttccattccacacaatggtaatggctaaagctgagattaagcaatgcagctggattagggctgcaactggtgaccttaattttacccatcattggagcctgtgtacatttgactcttcttaattgcatttgcctaatttaaacagacaatagtagcccaagacattttttcacccccaaataataaaaaaggaagaagagcgttttcctagaaattaaccacaggacagtgttgttatgtctgctgcttgggtaacaaaagcagctgttctctttctcttgccccattaacataccagcactggggaggacccattgagatattatccacctttgcataacaatacaactttaaagtctcatagtgcttctttagcgaaatattttaaaatattaatatcatcccagctgtaaataaccatgatggaattcatagagattaaagttttgagatccgccttaggtgtaccttcacattttcttgttcattgagtcctaacttcagtaaaattagtttttttagatagagctctgaacacttgctgtgactgtcacttcatgttgaatttatcatatagaatttaaggcggaagactggggagcaatctgtcacaaacgattgtattcgtaatcgttgagggttgggatgggggctggggagaagataagcatcctagggccgctcttgtcgcctgcaccattcattcggctccagtggcatcggygaggcgatttgtgtaggctgagtgtgtaatgtgtttccttcaagcctgccttgatggttctgtctatgctgtacttcatgcacataaatgcctctcaggttttttcagctaagtgataactcagcttgtctttcccggtgaattcggtaataaatagatatatgggctagacgtggggtgttctgacttagttagatcctctcgtgtcctggaatagacaagtggactcaatcattgtgctagcaacaagatacatactttccagggaagcacggggttttatgctaagtttacaatgacatgaactgaaaagcaattcaaagtcaaggttagtatgacaacctcacatccgtctagggcatctagaggggaaaacggtcaaaatgcaacattattttctttgaaaactgaacatctgttaggggattttgaaatgatagagaagtagaacagttgagttgcttcttgaactcatttaatgtgtacattttactctgggaagtaagtattttcccaagactgctattcagcgctgcatttttttcctctgatgtgccaggcgtttcttcacaacctctggatgttgcaagtcaagtactcttaatagcttgcagatctatatctgggtatcaaaatcacaggcttttgaactttgccaatcagaatcccacattacatttcctttttatgtcacatgctcaatgagcttaattgacacatggaaaatttcctgtatacatcttactcaaggcaacactggaaatttgggtttatggaatgcgtcggcagccctgaacgctcttggcttcttcgctgctggcttggtctgtggcccagaatgatgcaagttaggcgtagctcagaactctcaaattagctgctggggcggtgttaggagtgtgttcaggctcaagagccatttttgagggctggaagagggagtggggaggctctggcccactccccactgtgaggcagcggaggttacygttgtttgtgaagactcaggccgttaacttctgcaggaaatctgccctcattcccagcctgcagtatggctaggggcctcatcctgggcccctgtgggatactgggattattctgtctgtagcacttatcatattacactaaagatctgctcatggttctctcctccaactagacgggggaggcattgagagacaggactcagcacccagcactgtgtctgacctgcagagatagtaaaggcagcctaggtgctgggtaggctctaagactaagcaggactggacatggggatgccaatgataataacagctcctaattatggaacaggtactcagtgatcataaatgctagcctaggtgattccctacacccattttacagatgagaaaggtaaataagatgtagcaaggtcaggtagtgttcacagggtaaattaggaagccagataactgaaaggggaactgggaaatcccaggctattccttatgctctgaacatacacacctctgatttatctgaagaaagataatacttccatgatcaaaatacaatggaatagcacttacagagctagtgaagcctagaaagagtccaggccttgctgcagttttcttccagtggcactcagaggggtttgtgttttcagtttctgtattattttttggcctatgcagtatttcrttcttagcattttgcaataaattggtggtctctcaatatttctatgtatctggttttaccatgtcccagttgtgtgatcttggaaaatttacttctgtgttcctctgtttcctctgctgtgaatgtggggatggagggttgtcttcaggagtgaccattctaatatttgccaagatcctagaatggtgcttagcacgttctgagtgggcagcaaacattagatgttctgatttacggttctagctgtccctgtctcttctctcttctgcttgccactgtccccacctacctgagcttccctcttgtggctgtgctgcccacaagcgtgttgggtgctgggaactttgggtggcgcatttgctgcatctgtcagcctgggattaggggccagtggtccacgctcatcctctctgagaggcagccgcttctgcaggggctgccatggattgtggcttgtctgtaagtggcctgcttctctggccttcgccccctttccatctatcaaaatctctctctgtctccctgcctctctctctccctcctctcaaaggcctcgagcttctcccctcttcctccctgctggcattatctcctcccacagcttgagctttggggaaacaaaagccaggtgtcttggctttggacttttaaaacaaacctccctcgaggcaggggcacagagaggcctgacttcctttgtagagcagagggcaaacgctgagataaaaacacaaattaatatatcagtaaattatcctgccccactgacatactctctaatcagaaagacagtgaaaacacgggaggatgccaggaaagaatccaggggaggaaggaggagccacacagccagcagcagcccaaggagagcagcccctcgggaggctgcaacggctgaacttttcccctgacrttttactggatgtgcagggagcaccagcttgcaccaccgtggggtgacaggaagagagagacaacagtgagaaatggagaatggaggaaccaaggaagaaaaccgaggcaggggcaaagaggcagggctaataaccatgtgggctaagatctcactcctttggactcataatcatcacagtgaccttccttagtggcctcactcactacagaagtcaccccattttaaagatgaggggctgggcatggtggctcacacctgtaatctcagaggcgggtggatcacctgaggtcgggagtttgagaccagcctgaccaacatggagaaacctcatccctactaaaaatacaaaattagccgggcgtggtggcaggcgcctgtaatcccagctactcaggaggctgaggcaagagaattgcttgaacctgggaggcggaggttgcagtgagtggagattgtgccattgcaatccagcctgggcaacgagagtgaaactctgtctcgaaaaaaaaaaaaaaaagaaaagaagaaaaaggtaaggaaacaggaagtccaggataagtggactttcccaatttcctgcacctgctaaatgatggagtcaggttttcagccagaatgttggaagatggtgatcatgcagttaaccactttgctattaatacaggctccctcttgacaagtctgtgatctgatcaaactggagaactcagttggtgtacgtaaacagtaaacaaaaacctggtagaaccagaagaaattaagactataaaagagaatgagccagaagtggtggtgtgagcctgtagtctcagctacttgggaagcttaggcaggaggatctcttgagcccaggaggtcgagactgcagtgaacacgccactgcactccagcctgggtgacaaaatgagaccccatctctaggaaagtaaagaaagagaatgaagctctactcccaggacctcaaatatgaataaaattttcaagtgaaagaataaaattgtcacatccaccacgcgctgaagagcttgcacaaacatggcctcattgcctccactcagccccctgggataaatcagggattattgcccttttatagatgtggaaactgaggttcaaaaaaattaagtgactgagccaagtaaataagaggcagagtttaagatggaacacagttctactgactcaaaatccaatgttgatgacatggaggacagtatttgtcagaggggctcatagccctgtactcaagggctgccaggaaagaagaataaactaatatcccttctccccatgcaagctggtgggttcacttaggaacaatgcatgttaaaggtaaactagtggggttgcacagatgggaagagaagagggattttcaggtggctttcagctgatgcatttgatttggcaggagaggagaggtagttgggattcaagatatgaaggaaatacgcaggaagggagcaagagtagcaaaaattgcaaagctgtgagatagagaggaaatgcaggaaggatttcaaagcagagtataggcaaagaatgcctggcatacaatctggagaggaaaaagatggggaaaggaagtaggaagtgaaaaccgagggaagtggaaaagaaagtgaacatgtggatggtttggaagctgtcctcaaaaagtagaaatgtggcctggaatctatacaacacaaacgaaagggaatacaatgtttggggcaggagaggaaacacctgcttaagaagggtatttgaaaagtcagagccacacccagaccagaagattcgggcagactgatggacatcattatgatgagaaaaaaaaaatatctgtaagtttcagccaaaataaaagaaaaaatgtggagtgaggaaaggaagaacaaccacaaaaccagtgttctttttagaacttgctagaatcacaatagaaatattgaagcactattagaccggtattttctaaacatatctgaggatagcacctcctcttatttttaatttttactttttttaattttttgagatacagtcttgctctgtcacccaggctggagtgcagtggcacgatcacagctcactgcagtctcgacctcctgggctcaagtgatcctctcacctcagctccctgactagytgggatcacaggcgcatgccaccacacccaactgatttttttggtttttagtagagagggggtctcactatcctgccaaggctggtctagaactcctgggctcaggcaatcctcctgcctcagcctctcaaagtgttgggattacaggtgtgagtcaccactcccagtcctcttttttatttttaaaaaaccttctttaatatcttgtggaactataattttaggaacatagtttataaaatgttaacttggtagcattagggtggacttttccacccctgaattccatcctcccaaattgtagtcctttttgagttttgaatgatggctgattactcttctgattcttggtgctttcaccatgcctgcctatatgcaacctctgttagggttatgagctggaaacccaggcttgttagaattttgcataaataagtgtcataggattttgagcattggctttagagagtcttccatgagcaaatatatgagcttggcaccctgaagcttttgcagctattttgactgcccacaggatttttcttgcttacttactsgtttcttagcttccattcagaaggcagaactttccagctaattgacctccaaatagttgaagcgtgattgtattattgctactaataatattggcattgcataaaagcaacagaacaagtctgcagattatacactgcagaggccctttaaagaaacagttaatccagagattaggctgcatattytgaggactttttcaaatttttgtcaggcacacactctcatctgatgcttgcaacagtgttgagcatattgtttgtgaagtggtagtgaaccttagtatgagaaatacatgaccacctactggtggggttacaaaggcagaaattcagctataatcaaacaaacaaatgcattattctttctacacattcatgagacaagagcgtaaactcacttgtggaatttacagttttccacaagcggatttggcggaggcatctgactggggatgtttctatgtctttcactgtatgcatctcttatcataaaatttaaacaaagaaatgaaagttggccacttgccatggaattagattccatcatagaataaattctcatcactagtcctaacggtgatacccaagatacctttttggataccttgaaggtaggatacttcagggtccaatcagatacatcaaaggaaaataaatgctaacataaaaatggccaaaggaagggaaatagtgatgtcgctttgtgcaacttttagagtagtttgtttcatgccagacattacttttatcctttctgccccatttattataaaaattttactttgaaaatgttattttagaaggaaattttgttgtcacaagacttaaacagaggaggtgaaagaattagatagtgaacatccaggtatccatcaaccactttcgacaatgaacactttacttctcttgctttttcatatctcttgccatctgtccctccctccacccaatcatccaaccgtcttgattttctgatgcatttcaaatgagttgcaggccttgatactgttaccactaaacctttcagtatgcagatcattaactagaattcaatatttatttacaaggtttgtttttgaggtagatacagtataatgtacaaactatgtacattttggtggattttggcaaatacacacaactgtgtaacccaaacaactctcaagatctgggatgtttctagcatcccagattgttctctcatgcccatcccaccaatccttgccccattttcccaaagacaaccattattctgatatataatttttcaccctagattagttttacccattttaggatttcctgtagatacaatcacgcagtgagaaaaagatgtgcagggctttttcactcagaatagtggtttggagattcattatgttgttgtgtgtatccactgtagtttgttcctttttattgttgagtagtattccattgtagccatataccactgaggagaatttttagagagagagaatatgcaccaaagaatgccagagaagagtttccgggataatgagatggkggtggttggggggacctgaggtattttactataaaaaagggcacttttaggaaaggacaggagaactaccttctactatttaaggcaagaatcagcaaacattctctgcaatgggccagatagtaaatattttaggctttactgggccatgtggtcttttttcaagtacttaattccgacttatagtaaagtaaaagcagccacagacaatatgtaagtgaagtgtgattgtgttccaataagacttcatttatggacactgagatttaaatgtcatgtgattttcatgtgtcacaaaatattattcttcttttgatattttttccaaccatttgaaaacttgaaatccattcttagctcatggcccacataaaaacagatggtgggccagatttggcctacgagccatagtttgtcaatctttgataaaaaagcactgtcaaatggaaggaggaataattattctgtttagaactagtgggcaatatgaagactaaaggaggcagcttctgctcagaaaactgagtaattaaagtagtgttgaaatggactctaattccctactttgtctctgtcccttgcccctattggtagcatagaattagcaggacaggctacagggctagtctgtttagtgcaattgtccagctcttctcagtctatctgtgtgacctctggcaagttagtgaactcttttctgtttccattgattcatctataaaataagagcaataatagatcctacctcctagaggcattttcaagattcaataagttgagtgtctatgaagttctaggaacagtgctgattcacagtcagtactactcaatatacttaggacagtgtctggcacacagtaagtatgaaatatgtgttcattattatcattactgttgttattgctttagtcattgggaagttggataggcatgtgcgagaattttgttgaaggaattcctacttttcatagtaggctggactaatagatgcttaagttgctttcctgtcctaatcatcagcattctcttcaatttagtgccggatactttgaccctgaggctcaactgttgttgaaatctgagaagaaataatataacattctagtcattaatattagcatagcctacataataaggtaaaagtacagttgggcctccatattcctgggttccacatctgcagctttgagcaaccacagattaaaaataattgtaaaaaaaaaaaagaagtaataatacaacaataaaagtaatacaaataaaaatgcagtataaccatttacgtagcactcacattatattaggtattgtaagtaatctagagatgatttaaagtatacaggagggtatgcgtaggttatatgcaaatactataccatcttatataaggcacttgagcatctgcagattttggtattgaagggggttctggaaccaatctcctacagatacagagcaatggctgtgtattttgtttctgcttgatctctccttacgctggatcttggacctaactctcagtagatctgattaattataaggcctcatgtggatgctgactagttgtaatgctactttaattttttctccatgtgagaaagtgagaggagtagggatctttgctttgtaaagggaaatgtgtcaaagcattaagcaagcattaatttttcctcagagctttattcacatattggacgatgctgaataaccrgagagttrtgcgattatgcacaacattattaatgcaattatgtctggatgtcctgtgatgttgtgggactggtgctccaagcccattatgattgctgttgcctgttgagaacaggggaatccaaayagagttgactgtggcagatctccatttgcaacccctcatcccccagttataacccttatactagattgttgtctttgtttacttggtctctgaaatttattttcccaagcctgattatgtatcgtctttttctctgttagctggctggaatgatggcccctgtttctaggtgtggtaagcacgatataaaatcacaaaatggtactaacagagacctgtgtgattatttatgtcaacattttcattttccacatgaggaaaccaaggcacagataagagaaacttcatgcttccagtccagtgctgtttgtattatgccagattcatcttcgactctaagcaggatcggatgtggggtgtgttgttgaaagtggcaggagagccagatggaggcaagccccaccttcatgcctacaatgtagagttttggcattatttccaaataaatatatataataactggaatactactctctgttatattgaacactctcagaaaacattataaatatcaaatgttaaagcctaatttattaaaaagtcctgttaggggatgtctttattatttcacatattggaatctcaaattgtggcattggtctcagcctttctgtaactcacaaaagctctactgatgagaaagtgataccatagtatttacatgggtgcttaaacatttagacatccatgtgaacagacgattccaggaagaattgctggtaggacacagagcaacatcaaggcaggccttgactcatcctagatgataagttaaaaaaaaaaaggtcaacatggacgtgaagaaagaacaataaaagggaagaaatgctagatagtgaaaagggagaaaagaagaaaagaaaggaggtagtgtaccctggcagttcccaggaagttaaggtggcaggggaaatgcaaagctctctgatggggatgaggctcctagtcttttgacaaaaatagaaatgggggctttcaccgttaacccccacatcacttaataaagcctgttcaatagtctcatgtgttttttgaagcataaaggatttgagttgactcttactattttctagcttgactcaaagatggtttacagcacaggaagttccaaggtttcacataaacaatgtcatgagagttattaatttttggagttaagattattgcctcctaactgactttctgaactttttggatttagaaactactgctttgaaggcaaatatttgctttccatattaaaaaaaccactttttagagtatgtaaaatgacacactaacatgaactaaattcataatgaagccaaattctttttaaaaatattaaatctataaaattagaaaaccatttcacccttttgtgtaaaatacctatgctaatgccttgctcactcgttttttaaaaaatcaattttaaggagaataaagaattctgctgcaaaaacaagttgaaagtctaaaactcgtttattgcggtagaggctccaagatcacacacgtccattagaggtattcagtgcagggtcactggagggtcggcaagagacagccaattagatgtctgtttttcctttcaaagtcctgtctgtttccttcactctcttcaaaacaccctaagtagacatatatatcatgaagtcaaagcgaaaaaaaagaaaaaagaaaagaaaaaagaaagacaaaaagaaagccttagaacagtgggagttttattatccaatagtcatatgcattttaaatacccatcattatcaagaggaaaaacgaagcctggtgtctggtaagaagatgtgctacaaagtagaatactattcaattttgtctaaactcaggcaggaaaaggctactgaatgcaatccttggtttcccaccgtggaagatagatgacttcaaagttgtagcaaaagtatttgtttagagtagggaggatcaagactttctggtatttacagtgaaaaaacaacaacaacccagcctatcttttagaaaaggaatgcatggttaaattggctcagcttgtccttagcaacctgaactcggaggccacattttttcctctctaagaagcaagtgggaacttgaaaagtatgtagcatgtcgtgaaaagggagcagtgaactttgcccaggtctgcagccagcactgaaatctgaaccttctgtagtccctggactggtgtcccacctcgctacccccaaccttcctttttaatccctctgcatagagcgccttagcaaactaccttggcctggaagcagagcagttgtgacttctgagggaaaacctgttctctaagtatttctgatgccattaagaaggaaatgctaatgacaacaaaaaaccccactaaaccccagctttataattatgattatgatattcaaccttattttttataatatgtatggagaaaatatagaaagattttgttctgttgcattaattttcaagatagcttgagaagttttggaggttccctatgtagagattgtcactgcttggaaagatttttcttaccttgttggcggggaatatcatcaaaagccctgcatttaggcggcttgcagtatgaatcgtttcacaacagtaagttacttggtaacttgagctgcactcgttcctgaaattctttcacctaattgaagattaacttgattccccggattgttgatggtggttgacagtgtggggctggggtgggtggaaatagattattcaactcacaaagaagtaggtgtaccctaagtgactgttccattactgatcatgattgtttgccttcctaagtattcatcaaactcggtgctgcaggatcgtgtggggagggaggagagtgtaccgccagtgttcagaaagcaggtgaacctcagagaaacttcaatattttgtaaagagacttatatgtagtaatggctactccagaatccattaacgcccaaacaagccgactcaagggttctggctttctcaagtggctaatgtaaacaatatgaaagtcaatagtcggggacattccaagatagtattaacacgattgatttattgatggttgcacaatgggaggttatcttttgttaattgactcggtaaataagctcccaggcgtcagggcatagggggaaaagcaaccagtggaggaaaaggtgaggcacctggattataatttttttcaactcccagcctgtcttggtaaattccataccacttcctctgccaacctcaaacacagtttagcaattttaattccggccaaaactctgcatccatgtttcatgaggggaagactcaagggtggtatgttcctatcaaacaatccaactttctttctctttctttctttctctttctttctctctctctctctctctctctctctttccttccttccttccttccttccttccttccttccttccttccttccttccttccttctctcttttaaaaacttttacttcaggaagattaaagcaatagtagttgagagagagacagagagagagagaattcaccgacttggcttatttattaatacaaatctagaaatggtagggaagatgcatgtatgatcttttttttttctttttcttttttttttagatggagtcttgctcttgttgcccaggctggagtgcaatggcacaatctctgctcactgcaacctctgcctcccaggttcaagagattctcctgcctcacccccccccaagtacctgggattacaggcgcctgccaccacacccagctaatttttgtattttttgtagagacgaggttcgccatgttggccaggctggtctcgaactcctgacctcaggcgacccacccacctcggmctcccaaagtgctgggattgcaggcatgagccactgtgcccggccttcacgtgtgatcttttaacctccaagaaatgattgaaccatagggataatacattgtttgctgttggcagttatttatgcagcatttctccataaagactaccataatttggtacttcctcctcctatgaggaagggggaaagaaaaaaaaatgctttataaattttggycgactcctagtacagcagtcccccgtatccgcagttttgctttgcatggtttcagctacccgtggtcaatcacagtctaaaaatattcagtagaaaattccagaaataaacaattcctaagttttaaatttcacactgttctgaatagatgaaatcttctgccatcctgctctgtctcgcctgggctgtgaattgtccccattgtccagcggatccatgctgtatgcccacccctgcccgtagtcacttaggagccatctctgttgtcatattgactgtcacaatgtcacagtgcttgtgttcaagtaattcttattttacatagtaatggccccaaagtgcaagtatagtgatgctggcaattcggagatgccaaagggaagccgcaaagtgcttcctctaaatgaaaaggtgaaagttctggacttaataaggaaaagaaaaagtatcctgaggttgctgagatctacaataagaatgaatatagtatccatgaaactgcgaagagggaaagagaaatgtgtgcatagtatgtttagggcttggtgctgtcttcggtttcaggaatccactcagggtcttcgagggtatccctcaagcgcaaggggagactgccgtattatgtctgcggaagtgggacctcctagatcaattcctaacactttgaacttggcaagatagatttttttttggacttttacacttttatcagcgatagtttaaaaatttaaattgctcactgtttaacccttgctatcttctagaacagtggtccccaacctttttgcaccgggaaccagttttgtggaagatgatttttccatggacagggttgtggggatcattttgggatgacactattccacctcagatcatcaggcattagattctcataaggagcacctaacctagatccctggcgtgagcagcttacaatgggggtcagctcctatgagaatctactgccactgctgatctgacaggaagcatgatccgaagtgatgctccctcgcccactgctcacctccttctggggcctggttcctaacaggccacagattggtacggttccgcaggctggggttggggacccccgttctagaacactcaaaaaacatcaacttctcccttcacgctgtcttttcctctgtctccctaaggcttttctttttttgatacgggcattctttaagctctgacttctcttttcctctttcctctgccatctcccgtcaatctcttccagctgctggctgtactctgcaggggagttcagagtgagcgtgaagtacaaatcaacacctgcacccactccagctctgtctccaccttccaaccatttcccgtcctgacttttctatttctgtacctaacccaccccaacccattctgccattgtttttggcctcaaaacttggagtccgcctcacattcccactttcttctgtaagttctcaagtcctatagattctgcttttaaaatgtatagttcataaacgatgagctttgcctcccagatagattaaattggactgtggattggcacacggtaagtattcaattaatttttgttgaatgaagraatgagtgagtggctcctccttaaaccagggtccctgctccaaaatataatcctacatagctttgcatactactgtattcttcataataatcatctctgatcacattatttcagggctcaaaaactgtcagtaactagttttctcctcaatccagggtaaactactcttttttcaagtcacccacaatgtctttttgtttatcttccactaaactcctaaatatcctatgctcaatacagaatattgcttattttcctctaaattcttttttttttttttttttgagatggagtctcactttgtcacccaggctggagtgcagtggtgtgagctcagctcattgcaaactctgcctcccaggttcaagcaattctcctgccacagcctcccaagtagctgggattacaggcatgtgccaccatgcctggctaattttgtatatttggtagagacagggtttctctatgttggttaggctggtctcgaactcccgacctcaggtggtccacctgcctcggcctcccaaagtgctgggattacaggcgtgagccaccacacctggcctcctctaaattctttatatctctctgcttccctattttagctcattttatttcttcaatcagaatgtttgttcaatcatttttttaagctgcatttttttaactgtttttttgaggcccatttcaaatgctaccctgtccatggagctatttttagttccatatacttctttctcagccaagctagatgtgctcttcctcttggggcgtttattgtattcagcctgtatcgtagatatttctatacttgatttattctttcctaatagaaggtaaatgcttgggagacaggagctaaataaatcttgcttctttcttctaagcctggactctcagtgccttgtacatagtaggcacacagaatgctattattgaattacaatgatttttatattttcatccgtgtaagatttttttctttctcctttgattgcatgttgttgttcagcattgtgtgcgtgtgtgtttccccatttgctatgtcctgcttagcacctttagttttgaaatacacatttatttatgtatctttcccattttgacctagtaaataaaatgtattttttcatgtgactatccaaagtgagagaggatactgtgaaatgtctcatgaactgctgttccaaggtagtatttataagcaatcctttgatctggatttcttttaaattttgtgtttatctgtacacatttagggggtacaggtgcaggtttcttacacgcatgtattgtgtagtgaaatccacatttatcaatcattattttaaactggtcttcggaatgcaggcaggtccaggagcagggctccttcagtttgccctgctgcagcctgcttcgggtttgcccagctttctgttctttccctatccctcttaatgtctgggaattagttacgctgaagttccacttcatacagagctgcctgcaacttgagatgcaaactccaacactgtgggccactttttagaagcatgtggtcattcgggaaacaaaggcactcctgtttcctcttctcaataacaattaagacatcagattaatagaatctttaaattcttgaactatgctcgcagaatagtttgtgtttgctttaacacaaaggaatactttccaaaccctaaaggtcacccaagaaataagagagagacggcttatgaatcgtgtatgctggtagatttttggagaatggcatgtgtcctaggcagtgcgctctggctttggagcgacttggcatgggagtactctgtgatttacgctggagaggcatttcctgggcaaggaatcccctgtattgaaggggcatgccattaggaggagaagaaataggggcggggcggggtggggaagaggaaggcttcttggttcacattctggcattcacttaatgagtgtgatgttcttgctaatgggatttaaccacaatacctatccctaaccttgtcaccaaaaaggtagtctacatgccccttttttttcaataccgtctgcctggtaactgtgcaaaagtctgttctcccaattttctaaatggtaatcctagaattatcttggctcagaaatgaatgaagaacccgtgtacaggactcaaatttccctacaggggttgtaactgaagcaaggattaagtgccagtacacaaaacctctcaagcaatggacagcatgtckattgctaaacattctatggtagaaggcctttagtttttctcttttataaagcttgagatcaagttttggtaagaagtaaaaaagcaaggcaatttagctcctttaaaggattgcttgttgggaaggacagagctatatttagctctgtggctgtgtctccaggaagctaaagcaacaaggcaattaaatggtgaattgtgtgtgtgtgtagagagggggctcagggggagggcaggttagggagattataatataggccttaaaaagaatctgtttaggaaaaaaattttcaaaacagttgcaaagtatcatgaagatacagcagactattgactgaccacctgttgcacatcgcaaacctttattttgaagtggaacagacagagcctgaataactccaagttcccccatatggtgatagcaataataaactctctgtcatttattgagtacctactatatactaaacacagtgctttacttctattaagccatttagtgttgacaactgtgctctcggcagcaaataacaagagggtcttgcccaagatcacatagctgctaagtggttgaaacagatttgaatcttgttctctttctctccccacttttagttgcttatatacactatgcctcctatactcttccctgctgcactggcattttatgatctttaaattcttatattacagaactttgaccttctaggagaaaggcatgaaatacacccccctcccataatgtccatactcatatacgtgtgtgtgtgtgtgtgtgtgtgtgktaaaacatctacgtctaaatctacaatttaagtggagtgctatccttaaaaaaggaataattagaaactctcatttacattgtaatttacattcagatttcctggaactgtagctttactcttttttgcttttttttwaaaaaaaaaactccttttatttattataattcctggagatttggctctgctcatgtcctagatatagggttatggatgtggggcagagttcagcgagacagagctgtgtcaggaaacaaaacagcggggtagaattgagtgtcatataactagctctcagtcgttgtttttctctcattttgtgtggtaaacctaaggcctgtttgattttgcatcttcgaatttaaaccctgggtaaacaggtagatggcagccaatgatcccaagtggaaattattgtcttacaagagggtaaataatttgaccaaatctaaacatagaattcttcttctatgagtgcagtttaaaatcacagggcattttagtgcatcgtcatttttccttttcacacttattcccttattgagataggtaggaatcaagaattgcatctctgggaaaattgataagtgttctttctgaaaaaatcaacagtatatgaataagaagtatatttccttgaatgatattgttgttagtttaacaccttaaataaagaaggtattcaataatttttaggaaaatcaaatttagaaataaacattcagatatggaaggcctaacaaggctgttctcaaagtagacaaaggaatacttagaatcttattgaacctctttgggaccagctggacacgatcattgctccggtcctctagagctctaacattctttgaatcaataatagcccagtgccctttcatttctgggcccattcatttagagataggataaagtggtcaagaaagcaaaattcagctgttgagtccagaggtagttggagatataaatcagaatatttcttcctcccagatcaaaaagagagaagttcttatatctgctcgtgtttgaagcagagcagcaaaaattgtggtggatataaaaatctaggcttattacaagacctaggaagcaatctcagggggatggtcttgccatcagttacctgagattatttaattacaagcaactcgtgattacctgtaaaggcgagagatgcagtggaaaactcaaacaatgcttgttgcaaaatcatgtacattggcttgggaatatcccgtatgacattcccccccagaaatttgccttcctaattatgttttgcttagcccaatattaaaaattagttagtttccccggagtagctctgaagttaaactgcggagggagttggttcaagagcatgccaattggaatatggaggatgaaacattttctggcactaatgtggcaaaaaatcccaaagttattttaatcttaaagaaaaacataatcttgagcaccttaccagccttcacatattatctgaaatgctataaacatttgtaatgattacataaatgagattatttttatttagatatgtgtgtttttgccttaagaatgtgtgttctcactctcatccttcttggcagctaaagaaaataataaaccaattttcacagactcaagcatagtgctctgcacacacaattgggtcagaaatatttgttgaataaataaatgctcctgcttaggaagggtctcattttgtagcattgaagacagattaggctagatttggaaagttagaactagaggcggattagaaatcttggatccttgggctacaacgttgtcgtcatgggggggttcttgattgaattctcttctttctttccttcttcctccttccctccttcccttcctccctcccttcttccttccttccttcccttcttccctccctccctccctccttccttccttctttccttattttcctttccctgaatttaaatgacttcatagtctaatattcctagagcatatacaaacttgaaagtaggcatatattcctgaaatttatggctcttatacaattgcaaatccaaaacaaatttacaaattgaattcaaagaaaatgacaaactcagccttcaaattaacaacactgacttaatgtgatggacaatggtttgctaacgtttaattgctactcacagcattaattttgttccaactggtatgctgatgatgttttgattttagtatgcctatatttccttgtaatgtataagacaattccttaacacttttctgtatttaaactactgcaaaactttggtccacacagaatactggaacatcatttaaccttcacttggcagaaatccgtaatttacttacttgggggcggggtccaggttttgtggggcatgaagagtatacaatttttagggcttttaaaaaaatatatatatatatataataaaagtgaaacaaaattgctacggtccctcccaaggcattggaaggaatctgcataggagtcgaagctcaagcttcattagcttcatgctaaatccatctgtattcatgtatcaagcccgtctctatttttttcttgttgctaataaagaagaatgacctggcaacaatgaggagtggcatttttttaactttgggaagatcaatcttaaattacacattagtgtatttaaagattattctcaacctaaaaacagaaaattaaatattgtcattgatgacacagagacgactgagaagtaccttttagttaaattctttttcccttgataaattccaaggaggagttgctggaaccaagttttagagctctcaccaacttttcttggttggatttacagaggtcaaagtttgragtgcaactagagaggttagcagttcacttttcccagaccgcctggcttctcatagcttaatctctgggcacagctgctgtgagcacacagtccctgggactcatatcttgcccygctcctggcctgatgacaagactgggaggaactgtgggcaggtaaggccaaagggaacctcagaccaatatttctctggagggcagagggacaaacagaatccagaggttgggatctaccttggggacaatgtctcagagtccaatggttgcaatgagatgtgttgtgagtcagagctagggagggaaacagcaggcacaggggatgttgaaaggtcagccaggcaacggaaaccaggggtcaggaagaattctgagctatgatatcagttggcatgcatggtggggcaggtattcatatcaaaatcaagcaagtttcatttttcaggatccaagatcttcctgccttcctttcctggtaggactcaagggattcttcctgggctcatagayactaggtgtgaaaccatgcaaaaggacaggaaatgggtgtcactcttctttattgaggagattctggaattatttttaccggagttgattagagaataaaatgtggtagtcaagatcagacctgtcctctcaggctcttttccttctaagacaggagaatcttctgagaggttcccatagaagagaaccctcacgctgcaagtatccaggatacacattctgattcatgcgagttctaagaaaatctttattttgggacatttgaggcttgtcatcaaagaactctaactttctatctcccatctatctatctatctatctatctatctatctatctatcatctatctgtcttctttctatatattttctattttctatatatatttctattctatatatttctattttttatataatatatatgtgagatatatatcacagagagatgtattctttttctctatatatatatgtgggaaagtgttttgtaaatggtgaagaactactgttgttataatcccatttctgtccaatgtagatgctgatttttatcttgcttgataattgttttcaggtgagattatatccgataaatactttttaaattcctttttcttctgtttcctttctgtttgttttctttttgcttttgtttctttagttttctggtgaaaaatgattccattggaaattttatatcagaacaagtgttttcagaaaaggaagggattctcagatttaaaggaaaaagtttccctaaaagtcagagcagctagagctactaggaaacccctttatctaatcaatcaagtcttaactataacacactcaaccgatgcttgggtagaatataaattccaagtcacatgaggtcttatcagttataatactgagaaagaattagcccctctgttttggtaagatgatagctgtgggctmattcrttttttcttgatatatttgggggatttgaaaacttaggaagtaaacaggttattttgttcagggaaccttttctgaaagagttaccagggttcatctgatgccattagctttgccagtaatttccatgatgtcaagggcacaygggagattaaagagggattaagacctgcttgcacagtcaaagcatcacagtaaattgacttgacttggcaggctacacttcaggttggcaccttttcaccacctaatcatatacaatccaggtttgcagtgttagctaggctactttcacagaggccaagaaatgttaagcaggcaaggtaggaggtgaaagttgctgggaaggagtggatggacttccaggagaatgctcaaggccaggctgccaccatgagctgccgaggaggattaaaacattaaggaaaatgcttgttgttgttgttgttcttttttcctcagaatctttcaaaaatgaatttcattttctatttaccctccttccacccgctcccaagttttccagatatacgttcctcttaaaacctttttaatcgctcaggttattatcaactcttctgcaaaaggaatcaggtttgcccaggaacttcactgaataaagatgagtttatatcttaaaaaggaaacagctggatggcaaaagccagggcgggaggcagctcttgtttcattagtgaagggaaactcgagggcccggagagaacaactgggctggcagccacggcggggagaagaaaaggaaacacacgatcataaagaactaatcatgaaaaatggaaagtgagaaagagccaagaacaacaagcaataaatagatttggaagggggraaaagatgaggaggaatgaaaagctatgctcaggaaagaagcaacaagagcatgtgcgtttcatttgaaaaaaattaatgattctgaaaatcattaaaaagtcttaaggaaaatgttttaagatagcttttcagacccaggttttatttctatgtgttgtttcagagtctattccagtgcatgaaaaaaaaaaatcatgtggaactagtgggagaaacttarcatacaatgtgcctgagtgattggtttccctctgctttttttttttttttaatgatttctgcctgatggtggggaatagaagcaattagtttggctatgtaggatcactgataaatctggggattctaagattaactcatacaattctagtcgtaattagaaatatcaaatacattttcacctgtgcarkaatcacgtaatgttcatttatttgtcatgagggggtgataattcagcactcacaggtatatctttaaatattttcagacgaaatgagcatggatttaaggaggaactaagaggaaaaccggatcctagtctgtccttcatcttgaaagaggactattggtcatgttcatatattttatcatgttgaatctgttcatcgaaacatagccaatagtccaggcaagcctagagagaagatatatgtatatatatatatatatatatatatatatatatatatatatatacacactatttgaagtttcacatcagttacagataatactttacaaattaaatgttgttggtcttttatttgggggatgccttattagctttttaaaaattagtttttaatagcagcatttgtttaagaaggaagaaaaaatgcttggtggtaccttctggaaggtacattaatcttgttaatgacaccacagttcatggttggcaaaacaggacttttgaatcaacctgtattgtgtgtgtgaatgtgtatgtgcttgagaaagaaggccagggcactaaagatacatgagaagtgcatgaagacaggatgcaggatttcctatgattttatgttgttcttaattaggaagcatattggcagcaaatgctaacatgtgttaggatgtttagctgaagccaaataaatgttttctattacaactctgaattccatgcctggtcggaacccgtgcttttctgctcatggcttacaaaatcccgttaaaagtcatctcaagggccaattttctgttggctcacagagcaaaatgactttcaccacatgttttcctgaagggttatctacaactccgggtggaagtcaaagattggaagaggatgacctctgatcctggaactgcattgcttggtggtcaggaggggttcttagtaagcaaactcagtttaatcccagagtcggaagtgggtgtcaacaagccaaagcaacatcctttcagctctgctgcttttttgtcttggtggaggaatagccaatggaagaagatggagagtccggaccaaaaaaaaaaaaaaaagatgaggtaaagtagctacacttgtgtacataaggaaccatgtaaaagtatgctatgtatgtatgtatttatttattgttttgagacagggtcctgctctgtcacccgggctggagtgcagcggcaggatctcggctcactgcaaccttcacctcccgggttcagatgatcctctcacttcagcttcctgagtagctgggactgcaggaaggccccaccatgcctggctaatttttgtatttttagtggagacaggttgccatgttgcccaggatggtttcgaacttctgagttcaagtgatccttccgccttggctggccaaagtgctgggattaaaagtgggagccaccgggcccggccatttttttctatccacgtctttttcactgctgtgtctgagaaattttacacgctctcatatatgtagctgaaatgatgcaggagttccccggcaccagccgcttggtactctcatttattaatatcaataaatcaatgaagccaggttgcaaggcattcttaggtattcattcaccatgctaggaccgcattgcctggagctcttcagcagtttttcactgcaaggccttcacacaagctagtccctctttctggaacattcctctccacgttttgcacggcctattccctcgcctggttcagatctcttcccaattgtcctttctcctccagctttccttgatcccttcatcattctttcctctatttgtatttatttatttttgttcattgttttcttccctcctctagaatgcccatttcaagaacgaagggaatttattttgttttccctgctgtgcctcaatgcctaggacagtgtgaagaacatagaaggtgcacaactaataatttattcactgaattaacagggccagggtgtttttgttacttgttacagatgtgtgtgtaacattttcaaagccttggaagttattaaatcactttcccgcattttatatgcaagactcctattattcttaataagagtcagctgtacatctagactgcattaaaaaataagcaaaactacattttccttggccttgtaaacaatcccacatggtatatgggccaaaaaaggaaaattaacaraaaagggagaatgtaccaaaccatattcagttagtaaaaggggatgtttttccatattcttaaatgaagatcttttacccaatatatccagtctctcataaaccatgaaatgaagtgactgggtatcagaactaattttcagaagaaaaactgtcatctttaaagcagtaaaatcttcataaaactgtgtaaactaattactgggttaagtaaaatcactgaaatatatcaggaccttcaaatgtctccagggcagacataatatagtaattctctaatagtcactctggggagatactgtaatgggcgggatgaagtcattgtaatattctcatttagtttgggtcctgagacttataaagagaataccggtggcagactgcacatacggaagagatgcctattyatttcacatgatactagctggcctttccaggctgtggatcatgagctcaggggagcccaatggagatgggcatactcatttgttctgcagagaagatatgccgaatgtttcttctcatccctcctcatcaaagagagtggaaaatattttgtgtacagtattttttgctttaggttatttagaagccttatgtatattaggtttttacatgtgagcaaataactaaaaacaagarcaggacctaccagaagcttcaacagaacagacagaccatggaagacctcatgttcttttgaattagtgaaaagctatatagtttaagtaggtatcttggtaatctaggataaatcacaaggattgggtaaactcaatggaatattgaaggtttattttattaggtaattttatatacatttaggccacgtgcagtggctcatgcctgtaatcccagcactttgggaggccaaggcgagtggatcacttgaggtcaggagtttaagaccagcctggtccaacatggtgaaacgccatctctattaaaactacaaaatttagctgggcatgatggcacttgcctgtagtccagctatgctggaagctgaggcaggagaactgcttgaacccaggaggcagaggttgcagtgagccaagatcacactactgccctccagcctgggctactgagtgagacaccgtctaaaaaaaaaaawatatatatatatatatgtatatatatctgtaatgtgacattgttttctcaaacctcagactaatcttatgctcaatatggaagataatcataactcatcactctggattataactgcttacatatgtctttcttatgagataatgcaccttgaaggtaaggacttcactttatttgcttcattctccagtgtccaatttgtggaatgaatgaatgacccttaacagaaacctgactgtgattcccttcactattaacttttcctagagttatgaattccagttagaaatttgttcagaaaatcacttgtccttaggaatataatttcacaagacacacaagttgatttccttatartctatcatggtgatttctaccctggctcaaggctgtgattcatgaagaagagtggtaggaaccagacttcttaaaagtggtgagcatcaggccacaatctcagaggatagtgtatgaggagtaaaattgggaagacacattcacatttacccaaatggcttgcacattaaaagctgtacaccctccccaactccaattaactcagagggaaatctttgggcgggtttggttctctccaatgtgtgtgagcctgcagttgcctggctggctcctgtgtccctttggaattgataatgaggttcaagagagaggaatagtcctcactaagcatgtcacccctatttagcaccttttccaggatggcagccactattgttttattatgtctctgatcagctgtcactattcataaagtaatcactgccattaacacatcacgcctcaagccatctgctgcagcatggcacacacagagctgttggttgcaagcaaagcaggtgtcacctaaaaatgacagtaccacagtaaaggtgggaggtcatcatggtgaaagaggatatgtcacgtcaagtaactctattttttgatgtattatagtgcaatgagcaatagtatttcttgctcaatttgcagaggctaaaattaaaacttcttatttgagatactttttttcaatattggtaagtcatggagacaaaaaatgtcattgaagttcttaaaacaatagcatctagattgtgaatgaactcttgcattaaatttgcagtcaagtttaaagcattcttgaagagatctgatccatcaaacctttatttgacaagtgtttattgagcacatattaagtgacactgacatgtggctggcccacccgaaatatacagttgctacgtaaaacaaaantcacaagtaatgtgtacagtggagattcctgatcccagctgcatttttgacccttggtcagtccctaacacttatcttgattttggataattttttggatagttttcagttttaacaggatccatattgattggattttatgtggatgtgttggaaaataagcttgcattggaaaaatacaatgatttcataaagtctgttaagaaggacaatatctttataggacaattagttctcttgaccaccttcattgtaaaggggctttatatttatacaactgagagaggagataggaatttaattgaagatcttaaatgctgatagaaagtgggacaagggatcataattgggttcaactatctttctagccccttcccctcctgcatatacactggaattgcatccttagcttaacttmagaaaattcatgtatttatccttggcaaatatacacacttatacatctatatgtatatgtaaaaaattaactagggtagttaataattctaccctccattttattgcatgagtttctgctcttttcctgggagtgagaagtattggatgagggtttggatcttctagcccatcagttactcttagcaacatcacccatcctttcctactggtgatgagagcatcttgctgcatgggtggtggttctcaggtgtatacaacaagtactcttctccatgatgcacatgtccacacatcctgtatgctactgctggtttaagggattttcaagggtcaattcaatagtacatttagaaattaacttctgtgaaacatgctactcaattacaaaccaattgaggaatgctacataaccccaaagtctatagaaagcaaagatatccatcttctattgatatagaagatatctataagatatctatatagggatctctcaactacttttgaatccaactttcttttgagaatcaaaaatctcaagctctctccctatccctgaagatttatagaatcatctgttgtaaccaaaaaaataaaatcgagcttgaatttttgtgcattcagaaaaatgtcttttattatttttttcaaattctataatgatctatatgcttttcaaaatgggtcccctttctccctggggattatgatatgcccaagcataagaggcattttaactttaaggatgatatttgtgaatctgggatgcacgcttttcaagataccagtgaagcagcagaggatgagcaagcagaagtgtctcctgatgactgatggccctttctttttttyttcttttttttttttgagatggagtcccagctcggtcacccaggctggagtgcagttgtgcaagctcagctaactgcaacctctgcctcccaggctcaagtgattctcctgcctcagcctcctgagtagctgggattacaggtgcccaccatcacgcccagcttatttttgtatttttagtagagacgaggtttcaccatgttggccagactggtctcgaactcctgacctcaagtgatctgcctgcctcggcctccccaagtgctgggattacaggcatgagccaccgcacctggcctgacagacggccctttctaaggagactgaggtggtacatttgtgattaccagatacgatagagttgatattgaccgttgcactagtgacttaatagtttttttaaaaagccccaaaattgtttgatatttcatttgcatcaaaatgttgtagctcaaatggctttatcagattggctccttaaaatatcatgtgccgttgttctaggctcagaaggaacacaaagacaaagacaaatggttcttgggtcctgccctcaaggcacttacagtccagtttcagttttagaagttcaaccaagaacatggctaatggctggtagagattgtactgactattataccacttctcctaaaatattattttggttgaaataataaaatgtagattcaaaacaaaataaaataatattttactgcatttttctgtgaaagaaatgggggaatcttgggatttcaagataatccaacaagctgagtagggctggccataggtttggaactcatggagatcacagtggaaacccaggaaacattctcctgagggctgcgtctccattaatgttttctgcctagggaatgtgctkgctctggctctatgggtaaacaggagggtgaagaggaggctgactgagttaaagacatcagcaggttgggaactattaacactgaggatcatctttctgtttttattttccagacagggtctcactctgactcctaggctggagtgcatcatggggctctgcagcctcaacctcccaggaccaagcggttctcccaccacagcccctcgagtagctggaaccacaaatattcatcaccccacctggctaactttttcctttttattttttatagagacaagttctccctatgttgcctaggtgagtcttgaactcttaggctgtagtcatcctctggccttgggctcccaaagtgctgagattacaggtgtgagccactgcacctggcagttgaagattatatgcggatcacctaggtcaggagttggagaccagcctgaccaacatggtgaaaccccaggggctctactaaaaatacaaaaaaaaaaaatagctggtcgtggtggtgggcacctgtaatccccccttctggggggtctgaggcaggagaatcacttgaaccagggaggcagaggttgcagtgagccaagatcacaccactgcactccagcctgggcgacaagagcgagactccgtctcaaaaacaaaacaaaacaaacaaacaaacaaaaaaaaacagaaaaaaaaaagacggttataatgggaccatatttttaccatcccatttatatgtttaggtatgtttagatacacaaataccatggtgtgaccattgtctacatcattcagtacagaaatatttgtacggatctgtaatctgcacaaatctgtacaaatattagcctgtacagatttgtagcgtagatgcagtaagccataccgtgtagcctaggtgtattgtaggctacgccatctaggtttgtgtgactacactttttttttttttttttgagatggcgttttgctcttgttgcccccaggctggagtgcagtggcatgatctcgcctcaccacaacctccgcctcccaggttcaaacaattctcctgcctcagcctcctgagtagctgggattataggcatgtgccaccacgcctgactaattttgtatttttagtagagacggggtttcttcatgttgaggctggtctcgaacttctgacctcaggtgatccacctgcctcggcctcgcaaagtgctgggattacaggcatgagccaccacgcctggccgtatagctacactttttgatgttcacacagtgacaacaaaatcacataacatttcatgtctcagaatgtttcgcaatcattaagtgactcatgattgcacttaatctctctggtctgtaaaataaagacaaccagaagacctactccaaaggattgttggggtgataatataatgcttaaaattaatactataaaataacgtaatacaaaatatttatgatatttataaatacagacataaaaatatagttttacttatgataatatttctttttttctttttttgagacagagtcttgctgttaccccggctggagtgcagaggagcgatgtcggctcactgcaacccctgcctcctgggctcaagtgattctcctgcctcagcctgccgggtagctgggattacaggagcccaccaccatgcccagctaatagtttttgtatttttagtagagacaggttttcaccttgttggccaggctggtcttgaactcctgacctcaagtatcctcccacctcgacctccccaagtgctagtattacaggcatgagccactgtgcccggcctacttattatgatacttctaagcgtgataaagcacttatacgtctagcacacaacaaatcctcaataaatgtaatgtacgaatgtggcagattaagagaaaaagccaatgaaataaagctgcaatacttgcatttagaaaatactataggaataggacagaaggcttggctgactgaaaggaggaatatattaaaggaaatgtcttaagagtaggtgacatttgaattggctagtgaaagagagagagaatagcttgctaggggaagtatgaagagcaacgttttggaccatgaaagggaaggaaccaactgctttcttccttcattcctcccactgaagtgtttttctcagtttgtcttaaatctcactttatgggttcttcaaacaatttgcccatttttgtgtttacctgagtatcagatctgtcacgtagattttctttatggagactcacacatttaaaaaagactctcataaacatcattgtttagtattagtatagttaatcattttataccttaggcttacaatataatgattttaaggttttactcatccaaaatcaacttctccagcctcccttactattaactcactctttgtatttaatttattattcagttttctatttctttggactgagtgggcatgggaaatagaatgggagaggaagcacgtaattagaaaatattgtacaaagctgctggctattttatgtagaaaatgaaatttgggacctcaggatgcaaaattaatatgtaagaatttcatcactttgttagaagatgcaatcggagttcatccaatatactgtcagagacttggtggatatttgtcaattttgtttgttattcaggaggaatacctggattttctctgagggagtcatccctgcttggtctcggtctacgtggtttatgtggtgctttgccaagtccactccctatccaccttccagtcttaagcagggggaatagctcaagctcagccactcaggctttcccttccgggaagctgaattccgagtggtgagacacaaaagtgggaatatgcttggaacagattcttcctgtgagcagaaccttgaagaggctgtttattcattcctgctacctggagccctgaagctgtctggttcccatctttgttctgtcacgatctgagcgtccagcttttggtttctctgagccgctccatatccttccaatcattttcctcttttcttttgcttcatttagtcagagtttaactgatagtctaagtgatagaataaaaatgtgaacacagaaaaaaatatcactagatgacagctgggattactagacagcattttctcactggacatgtgttttgaaagcacataccagcaccaggcactgttctaggcacttgagtcagtgacaaacaaaacaaaatattgagaacaatagatgtggctgggcacggattcacaggctcgtgcctgtaatcgcagcatgttgggaggccaaggcggggggatcgcctgagcccaggagtttgagaacaatagatgttctaacaaatatttgttgttgggctttcaggagctaaatgaatgggctaatgacatttgttcaaccttaagataatttttatatgaccctctgtgagaggttctaataattctttttttaacaaacgaataagaatattaacaacaatctaggtaaatatttcgaaagagttcttcctttggaaaaagcaagccgagtgttgatttaaatttctcaatgatcaaagtgttaaagtaatatgttttgaatagagccatctataaaacatacccatataaacaacaaaacttgtaaatgtgtaatgggcaaaagtaataaaactattgaaataatgcattttcctcataccaactctatccattaattttttacagttttctaccatgtaacattacccttcataaaaatgatattttaaaatgagatggggttggtaaaagaaacaaggggtaataatggaaggaggattgcaaagctgtgctctgctggatgagggagaagggaaaatagaattcatttgggctttctgtgagccagaggccatggtctgtagcctttaaagggatgagcaatgctcagagccaaggatttttatatctttattttgattatttgtttcttttctctaaagaaatcaagcacaagctatttaaaataatgaaagtcacttcaatataatactttataagcaaatttgtgaatctctcatgtattaaacatttaaaaattcttcatgcattcttggatgggttgtataaaatctaaatgtaatatgatggtattcttgcatgaggcaacttggtgcagtcagagggacatagatttggattcagacggatctgagttctaatcctgactctgctctattcaagttatttgacctctatgtaactatttctttacctgaaaagtagagaatataactcctagcaagtagtgggtactcaagataagatggttttctggccaggtgtggtggctcatgcctgtaatcctagcactttgggaggctgaggtgggtggatcacctgaggtcaagagttcaagaccggcctggccaacatggtgaaaccccatctctattaaaaatacaaaattagccaggtgtggtggcaggcacctgtaatgtcagctactcgggaggctgaggcaggagaattgcttgaacctgggaggtggagattgcagtgagccaagctcatcatgccattgcactccagtctgggtgacagagcaagactccattaaaaaaaaaaaaaaagatggttttcttccactgccttcatccttcattctgataatacttcaaattatgaaagattagcttatttgcaactagaggccattacagtattattaagagacccactcaaaatgcttaatatcatttgatattatgtgtcaactaagtaaaaatgtacatgcttgcaattcctaaaaatgaaataaataaaaggttgaaatttttacacttgcattaaaatgagaatccatactgtagcataattttggaaaatggaattatctgggatatgaatgctttatttctccatttattcaacaaaccccgagcacctgttaaactcttggtcccatgataggcatttagaatacaaagataaatctttgtattctaatacaaaagaatacaaacatgattctgaatttcaaaaagttacttcaccctcttccatggtgaagaccacaagcagagaattaaacgcagaaatgtaggatggagtgccttatgggaacaatggggagggtcacctcattggtgagtgtggggtgtcaggggacacgggagttttccagcagaggtggtggtgaaggtatgtatgtcaagccttagggaatgagttgaagttatctaggtggattaggtgggggagactagagtaagaggacattccagagagtgaagcaggaaaatcagagggagatgaacccacatggtatgtgtacgtgtgtgtgaggtgtgtgtgtgtgtggggggggggggtaagaaagtcccagcaatcaatgttatgctgcacagagctagaggtaggggcaatgagagtgatgctactggagaggcaggcaggggccagttcatgggtgttttctttcccaggccaaattgcttaagctttatgcagaaggacaaacgatggcttgggcacagctgaaatacctctgctcacacctgtgtgaagaataacaattagggtggtaaagcccattaggaaatgggtaatgtagtctgtggtccggggccaggctgtaagggcttgaaggaggtcaggttcactgggacacagaacagtgggagggctgggtggttggtggcagataggggtgagctcaggcgcagaaggaagagagagaatccaggctgactctcagctctggagtgtggtacctgacgtggtgccaccatccaagatagggaatacatggacatgaataagggttatggtccaagtttaggcattcagtgaaatcaaactgtgagtatcttaagaattgggctgactgtgggtttttcaataccttggtgaaattttcttaaagggagctgcattgaccacttctcctggtgcatgcagaaggcctactatggagtgaccatggagatgataagacaaaaataagctttcactctgctccttagtagctctgggatagtgggcaagtcactttagcactccagatttcttgtccctcattgagagaataagtaggtttgacaaataacctctagttaaacaactagtcttatttggttcactaaaaccatgtaatgtggttctccttccccattcgttggttaacagtaaacaccccccaccccccgacacactgtgcaaaagtttccatctcccaaatgtatgaggcatttgatatttgatgtcataaacgggtttttcttaactcctatgaatattcttagctccttctcgtcaggaatcgcttgcagctcttag

SEQ ID NO: 10795 - DNA, 13885 bp, Homo sapiens
tattggggtggcccaatataaagctactcattagtttggttcctgagcagacctgctaataaacctcaaaaacacaaaagtctacttcactagccagaaatgaaagcaggatctagatctgagtgggaagggcagagggcagcatgggttgactctagttggaattgtgccagtcttctctggaggccgactcactcgtggagtggggaaaggggtggccaggccccagtctagaaaccccaggcctatgggaagtgatgccaggggaagggaagcagataagctggtggctagttcccaggaaggcaccaacctccaaaatcacctaggcaaggacagatgcccaggggtgccatctgtgaaaggggggaaaaggcaagagagcccagaaagaaacttggatgctatagggggttccagaaaggtgctccttgctacccccatttgggggctctgacatgggaaagactccgagtcacccagggaggagctgggcatgctgggcaggaaccaccctgctagcctctcccaaaagcaggggtctcaggccaaatgcccctcctgttcccttccactgtcaaccctctccagggaggcccaggctagccaacaggccactgggtaaaggccctgctgccctctggggtggtccagccctgcctcagatatcccggcggggctgggcagaagagagtgttgctggagtgtgctgggcccaggttttcaagggctgggaatgatttttttagagaaagggaaaaggcggtgtcaggaaccgaatgggacgacctccacaaagcaggctgggcaaagtcccatgatggcaggtcgctaggaagaggttccaggggcggcaggccgctgctgctcccaacccacacctggaaaaagggcagagagtgcaggttacccccccaggccaccgggcttgcccccactgccctctgggctcctcctactctgcccgggctaatcagcacactacctgagtcagaatgtgctctgtgatgagagaatcagagacagagagagagaaggcagcaaggcaaagacagatcccagcaggcccaccctgggtcatcctccagggagactgcctagcccagcacctgtgaacaccgtccacgcctgacccccaggggctctgccctacttacggcacattcatccctccctgctggtctccctgaaccctctccccttgccaccaacaggataaggagaagcaggttatcctatcagagactgcagtgcacaccccacaatcatggctcgccctcacttgatgggaacttggcatgggagaggggagataaccaaggagaagacagaggtgtgttcgctatccacacaggaaggctcagtggccaggagaggaaactcaatcttttgggtaccagcagggcccccagatattgttcaagcaggtaaaccaagggtgagaatctatctggtccagcgtttcctacctgctactttgcaaagagctaaaagaagaagagcccactttgctctccagtcctccagaaaccctggcttaggatgggttaaacagatgccagtgtgggagaggggaccacccactccctacctcctacctcccccactgccttgtgccctaagctgaggggacccaggaggagctctaactgaggtcagaaaaggggaagagtggttggctggaccaccaggagcccttttaaaaaaacctgcagtccctacaaactgctggaaaccaacagtcaggcccagcgcagtgccgggtctcccaacacaacatctgtgtgatacggcccaccatccaaggagccggcaaacaccaggagaggaaagccaagcaacagagtgaaggcaaagacagggtgggaaccaggaccaagcaaccaggaaggaggaacgtcagctgtgggggaagggggcctgggggaagaacaaaggaggagagcagagggagggtggaggaacagaggggaggtgtgcaaagcggtgggcggtcagccgggcccccggcacacgcagcggctggctcaaggctgcgaccgtgagaacagcatcatctccttcagcccatctctgccctgacccagcccctacctgacacttgtgaggccgctcagaagtgtgcacctgcttgatatgtccgttcaagtgatcaggcctggaaaagagagaaccaagagggactttagaaacttggccagaccccaccacacaggcacatatgcatacgtgtgtacacacacacacacactcactgctggaaaggactccctctccccaaccccagcatgacaaagacaaagtcaccacccagttctggctccacaggcccaggcctctctgccctggttttctctggaggggggaagagaaatgggcatttgtctctgattttgcctccccactccctcaattctccccaccagaaactcagtgttttctaggaccagaggcggtggcagtagaatgaaacagagctgcctcactgcagcctttccaggaggggatatgtgattcattgtccagactaaagccccttagaaactcagcaatcccctcccccagcctctcccgccacgggcagccaatgaatgccacccggatggaattcagtccccagaggccagcagtggagccttaagtccccagctgggctggtaagccagatgcccgcctgagcaggtgggcaggggctgcctgaccggtaagactggttcctggtcggggccctctgagggagttctccatccctgtgttcacacacacaaggtcctacaatccaggttaaaaccggccttttaggagaaaaacaaaatcaccctctgctcccagacaagtcctcagttccccaacaggctaactagaaagtgaacctacatagagatcctgtccccattcctttctgtcctgaaaacataaaggggctcgtgggtcccattaggctctagagctaccaggtcagagcagatcaaagcttttggtgttaagcagcagctctgggtgaccagctctgtgtcccatgatcccagggtggtgtgagaggcacagctggagtctactgatcaggatggccagtgttctgtgttggggaatctggtgcctcaagagtgtagggagtcccagatgcacttgttccagtacctccctcggcagccattcaagcggggaagtcgctggaggagcccagtctcccgcccccagagggggccccacgcctggtgccggaaacacaaagggagccctgggggaagaatggtgaggtccggtggctctggcctgaggaatccggccccaggaggagagacagtagggcacacttagcgtcaaaaaaacttccctgagggaatggaaagcaggtctcaggcataccatctcaaaataagggcccttaaaaacactctacccaaacctggcatggttctataaggtcaaatgacccccacaaatcccacacccccagatcttggcaggagccttttcaggactaagataacgtgtggcaggggaggaagagggggcctttcctcacctggagaagcctttcccacagctctggcagatgtaaggcttgcccacggacccatcatgggaccgcacatggtaggacatgcggtcttttctcttgaaccgcaacccacacacagggcaggagtagggcttctccccagagtgggacagcttgtgccggttaagatgatacacatcacggaagatcttgccgcagatctcacaagccacctgcttcctggtccggctcctctttcgggggccgtcggggtcttcagagatgggtagcccattctcacccagcctcggaggaggaaggtcgatgtagcccagctggaggctggtgacaccgtgctgggcctcgtgctgccggagccggttggcatcagtgaacaccttaccacatagaccgcatggaaggatgcctgcctccctcaggccccctggggacccaaacattgagtccagcaggttggccttccttgggcggccccggcctcgcttgccagtcaggggaggggcactggatgccacactggggaatggggaagtcagcagttggggggataggggtccagccaccatgggcaagcggtccaccccaggtaacacaggcaaagaggcttggcctgcaatggctgcaccagccgcccgagctgcctcctcctctggctgcatgctgccggcgatgccattgctgttggctgccaaggctgccccgttggtcatgtccaaagggaagcccaagtccgaggtcccaggggggcgaaagagcattatatcggcgcgggcagggggtaccaggatctgtacgttggactgtttgatgacttcctggcagatctcgataaccgacctcatcagcaggaacttggcggccgtcatgagttcgggaaagctctccaagcgcaccacgatgcgggaagtgtaggcgaagtccagaatgtccccaaataccttggagctgatagtgtgcatctccagctcccggctgcccccggccccgccgcctggtgctgccgtcgcgccccctacatcagccggacccccgtccgcagctccgccgtcgcccaactgggcgctgaacaccgactcaaagtactcgctgcaggcggccagcacggcgcggtgcgctgggaagctctcgtcgcctacccgcaagagcacgtcgcagaagcgcccgccgtttttgcgctgctggttcaggttgtgcagcatctccgtgctgtgtctgctcacctggtatgtgtagcagccagacgggccgcacgaagcgtcgttcacccgctccatggccgccgccccctcccactagcccggccgctgcacctgcccgccccctcccttcccctcagcagcgagaagcggggcgcagcagacgtgtccacactccccacacgtgccggcccgaggctctgtagtctcgcaggtgcgccgagtgtacacgcccccagcccggatcagactgtctagactgcggggtgcaccaccccccacatagccaacccccgccctcgctggactgcgcgccactctctcctctccgcccgcccgcctccccttcccggtctaccttccgggggggtgcgcgagcgaagaggtgcgcccctcctgcaaacgcgcctgccacctcccctcccgcccgccaggcggcgccggcgcgcagccaagaagggcacgcgcacgcggggaggagaaggaggggtccgccgcgcaggcgcgcgcgcgcgccgcggcttttcccgggcccgctgggggcgcgcgctgcgtcccctgcaaagcgcgagccggggcgggggcgccggagcggaggaaacaaaaggcgaaggcgaaggcggcggcggcggggcgcgcacgggggcggtggcgcgggccgggtcccggagcctggagggcggtggcggcggcggcggcggctggagcgggcgggcggcggcggcggcagagtaggcccttcctcaggccgggagaaggcggcggcggagcggcggctgtgcggccccgggctccgtgtgttcggagcggaggaaagatggcagcggctgcacttcctcttgcactttcacccctggggggaggagaaggagggggcgataccaacaacaccccccctctcgcttgcagaaaaaaaagaaacggcgagctcagagtgggggcccccggcgtccccggccttgcacgtgcgcgcccggatgcctagcccgggccgcctggcgctgcaaactttacactttctttgtgccgagcgcccccccctcaccaagacgaggatgcacgtccccccttccctatttatacaccccccccccgcagctccgctccccccgcttcctgccccccctccccattccccagatccgccaatgctagagcagcctgagcccccgtccggcccccgcctccccaccccgcccgcggggccgggggctgcagtctcagcccccccggaccaatgcaaacgaagcgccgagccagcaaaccagctcccactgcccctcccctgcccgctgagagtggcggctagcagggtgggggggcaggaactgaggggtgcggatccgggccccccagcctgcgaagcgcactcgcaggtcgagcgggcgtcgtccacccttcggagccccgctttcatgcgtgaaattcccagaagtcgcctgcgaccgcctccctgcttcaaacaccagagagggcccggggtcctggccggagacaggccgaacctccggagctgcttctgcmcccggtacattgatcgatctgatgggctgcgcgcccggaagagctggagagatgaagccagcgtccagcttctcccccaaaccacagyacgccgagctttgtccccggggagcgtgaagtcaccagctccgggaggcgacaatatgagggcgatggacggggcagggacccccggaagccccagcaatcctcagggaagtgggggtgccggaggagtcggggacaccctcaggcctctccaagcccggagcatccccagcgcccgcagccctgtgagacgccgggtgctctggtaatgggccctgccgccaggcctcggcgctttgtccccggcccgcccggggatgctaccacgctagagttgtacaccaaggtttgtcttcccaggaagcgctggcggctgcytttgggccgcctggcgcggagccccaggctgcaggcgccgcgtgtgcgggcgggaagttcccacagttgcaaagaggcagcgaagtatgtgttccaaactttccacggttccaaactgagcgcttccattaagagaagcggtgtgcgggggaaaagcattctgggtattagcatgcaaatgaacgggcccggcttccaactccgctcgggattcccaccgctgcgcgccgagctcgcgcccagccacgcgcgccctgaggcttccgggcgttgccctggcggatgatccgagttcaaaatcgagacctctgccttctggtttcgtgtcctggtgcttagtcacttggcctccctgagattcagttaaactgtttcttaacctgtgcacagggacagcagcacctgtcctgcacacctccgctctagggcatagtacatgccaaactcctgttggagagaatgaattagaggcatgaagaaagttccctggacacgaagccaggagatctgtgttctaagcccagactcactgtcaccttaggctagtgcctccctctctgagccacagctttcttgggcggattttgggaactggcacgttttatttttgagagagctgctgggaacatccacagagaaagagaaaggggccgggcgcggtggctcacgcctgttatcccagcactttgggaggctgaggcgggcggatcacctgaggtcgggagttcgagaccagtctgaccaacacggagaaaccccatctctactaaaaatacaaaactaggccgggcgcagtggctcatgcctgtaatcccagcactttgggaggtcgaggcaggcggatcacctgaggtcgggagttctagaccagcctgaccaacatggagaaaccccgtctctactaaaaatacaaaattagccgggcgtggtggcacatgcctgtaatctcagctactagagaggctgaggcaggagaatcgcttgaacctgggaggcggaggttgccgtgagccgagatcgtgccattgcactacagcctgggcaacaagagcgaaactccgtctcaaaaaaaaaaaaaatacaaaattagccgggcgtggtggcacatgcctataatccgagctactggggaggctgaggcaggagaatcacttgaacccgggaggcggagttgcggtgagccgagatcgcgccattgcactctagcctgggcaacaagagcaaaactgtttcaaaaaaaaaaaaaagaagaagaaagaaaagaaaaagaggtttgctctgagcgtccagtgtatacacacatcgtttctccatagtaggtacagatattcctattcaaccattggaactggggaaggtgagtgacctgcccaaggccacacagatagtgatggagccaggattcaaactggttaactgcccctttctcaccagtggcttctgaaacctgtcacccgtccatggctccacttgaaccaggaactgactctctgtctgctatgcttagaaaacaaggtgccatgactggccccattccagcggattcacccggtgaaggtgggttcagaaggtggtgctctgaggaaaacagggaacgtgcatcagccctgttttgcagataggaagcctgaggttcaaggagccagagtggtccaggatcccaccttggggaagtggccagagacagtccagacgccgttctgatcccacctgggagcttttttccaaatgtcgccttggcagtgtgattgtgggggtgggagtaacctctctacttcatccattactctcagtcttgcccatctctcaggctcctaggaatccattatgtaacttaaggcatgcttgcagaacatgtcttttttttttttttttaggtaacattcaactgacataaaattaacaattttaaaatgtatcattcactagcacctagtacattcacaatgttgtgcaaccagcacgtctgtccagttgcaaaacatttttatcaccccaaaagaaaactccgtacacgttaagaagtcactttccattcccttctcccttcatcccctggcaaccaccaatctgcattctgtctctatggatttacctattctggatattttttttatttatttattttttgagacgaagtctctgtcacccaggctggagtgcagtggcgcgatcttggctcactgcaatctctacctcctgggttcaagcggttctcttgcctcagtcttccaagtagctgggattacaggcgcatgccaccgtgcccggctaattgttgtatttttagtagagatggggtttcgccatgttggccagactggtctcgaactcctgacctcaggtgatttgtccacctcagcctcccaaggtgctgggattacagacgtaagccaccatgcccagcctggatattttatttagttggaattatacaatactgtatgtgaccttttgagtctggcttgtttcacttaacgtaatgttttcaaggttcattcatgttgtagcatgtataaatactttgttcctttttatgactggctgaatgatacaccattgtatggatatactacctttatccattcatccattggtggccttttggttattatggatagtgcaactatgaacatttgtgcacaagtatgtatttgagtgcctatcttcagttctcttgggtgtatacctaggagtggaattgctgggtcatatgatggttctatgtataacttactgaggaaccaccaaactcttccacagtgactgtaccattttgcattcctaccacacatgtttttataaataattttagtgctggtcaaacctctcattttatgaatgagcatgctgaggcccagagaggttaagtaacttgcccagggtcacacccttagtcaggatccagactaaaaccaaactttcctgagttcctagactttcaaacactaagagcctcccatgtcacctttaaagacctcgactacttgcccgagttttcattaattgacttagaaacctgcctggtgaacaactgagttagccgtatttatgaagctttttttctctcaacatctattgaaagaacccaccgccatgttccggatttctaggccacaccttgaaaacatgcagagctcacaatccctgcatctgcctcctgctgctggcctgtcgggccctcttctgttgccatggaaaccatgcacctcagttttggcagcagaccagctggacagcgaactgagaatatccttgtctcctaggctaagcagagctgtcaaggtcatgtattcattaactagatttgtatttattgatcacctactaagcaccaggcttttgttttgtaagatgctagggatacagcagtgaacaagccagaccacagatcctgccctcaaggaacccgtagtctagaggagacagacaaaaaccaaggaacaaaaaaggctttacctggctcctctccctagttcacattctcccaaccttccaggctgtgctaaaatccacttcccctggaccatccccggaagagcccaaatgcaggtgatagctcctctcaggatttacattgcattttttgttgttactccctgattgtaaaagtgctatgtgcattgtggaaaatgtaggagatacacaaaagcacaaagaagaaaaattaaataaagatctgtaatttcaccaccaagagtcgagcgctgccaacatttccttctggtctttttctacatatgtgtatttctctttaaaaaaaaaaaaaattattggccgggcgcagtggctcatgcctgtaatcccagcactttgggaggctgaggcgggcagatcacgaggtcaggagatcgagaccatcctaacacagtgaaaccctgtctctactaaaaaaaaaattagcggggcatggttgcgggcatctgtagtcccagctactcaggaggctgaggcaggagaatggcttgaaccctggaggcagacattgtagtgacctgagatcatgctactgcactccagcctaggcaacaagagcgagactccatctcaaaaacaacaacaacaacaaaaataataataatgacagggcacagtggcttatgcctgtaatcccagcactttgggaggctgaggtgggtggatcccaaggtcaggagttggagaccagcctgaccaacatggtgaaaccctgtctctactaaatatacaaaaattagccaggcgtggtggcatgcacctgtaatcccagctactcgggaggctgaggcaagagaatcacttgaacctgggaggtggaggttgcagtgagaggagattgtgccactgcactccagcctgggcaacagagcgagacaccgtctcaaaataataataataataacaactttgttaagcactatctgtgccagccatagtgctgagagcactccttggtttaccctctggaatcctcacaacaaccctatgaggcacttactctgatgattcccattttactggtgtggaaactgaggaatgagcagatagggaagggagaggaaggcccaaagcatgctgaatagcaggtacctctgcctgctccaggggctttcagcacaaatccaggctgccaggctttattgaggacctgatgggaggaggagatggagggaaacacaggaatgaggcaccctagtttctgccccactcgcctttagcctttatcagtctttcttagaaggcatgtgaagccaaccgactttctttgctcacttcaatgctgggctgttcaacttcttaataacaatagcaacaagaccattccttgaacaatcatggcacttcaagcatgaatggagttgttttggagccagacagacacaagttcaagttcaaggtctgcccttgctgatagtttggctttgggtgaacagtgccagaggttcatttaacccccatagcctctctctgagggtaggatcattgtccctgccttttgttttttcagagacagggtctctgtcacccaggttggcatgtactgtcaccatcatagctcactgcagtctggaatgctttggactcaagtgatcctcccgcctccacctccagaatagctgggactctgggttatgccaccacgcccagatcatttttacaaatgtttgtagagatggagtctcactatgttgcccaggctggtttcaaactcctggcctcaagcagtcctcatgcctcaccctcccatagggctggaattacagatgtgagccactacacccagccattgccccctgtttataggtgagccaactggaaagttagttggttcatccacgcctgccctcgtgaaggttgtgcggtccaaactgagcgcaggtctccctgattccaacagccaggttctttctccagcaccttggaccccttttctttctcgacagttgggtttccttcatgactgggaggagtgggcaaatcttccacctcacacggaggcctagctccttcagctacacaaggatcttgcaggagggagaggctcagcagttcctgcttccctgctccgtccaagttatctcagcccctctgtgctgtggtcttcaaggcccgactgggacccagtaggccacggtttatcattggccatgtttcctgcctctgcatcactagcagagactttaacactctttcttttcattaatcaggcacaaaaaggaaaaaaaaagtcctcatgtgtaattgtttgtatttctatactttaacctgggaggatttttttgtttttttgtttttttgagatggaatttcgctcttgttgcccaggctgcagtgcagtggcatgatctcagctcactgcaacctctgcctcccatgttcaagcaattctcctacctcagcctccagagtagctgggattacaggcgcccgccaccatgcccggctaatttttgtatttttagtagagatggggtttcaccattttggccaggctggtctctaactcctgacctcaagtgatccgcccgcctcggcctcccaaagtgctaggattacaggcgtgaaccaccgtgcccaccccaggattttcttttttgtgcctgattacctgaaggagagagagtcaaggtatcgctggtgacacgggggcaggaaacatggccacacacatacatacacgtgaaaggcaactgtctaactgaagaaaatcagctgcacattacagagaaagagttaatgtccagaagtgcctgaaggtcttcctggaggttgcccgtgagccaagatcacaccactgcagtccagcctgggtgacagagtgagactcagtctcaaaaaaaaaaaaaaaaaaaaagtcatagtgctcgcatgagttaagcttttaggtgagattcctgagtgacatttgattcaacagcagtgtataaaaacactaggtccttcccatgttgggttagctgtaatggtggttagtgaaatgtctgacaatttgagagccaaaatgattttttcatttattcattcaagaagtatttatgggtgtcttatttgtgccacgcaccgtgctgggcaatggagatgctgtggggacaagatatttggggtcacgtctgtaatcccagcactttgggaggctgaggccggcagatcacctgaggtcaggagttcaagaccagcctggccaacatggtgaaaccccgtctctactaaaattacaaaaattagccaggtaaggtggtgtgtgcctggaataccagctactcgggaggctgaggcaggaaaatcgcttgaacccaggagtcggaggttgcagtgagccaaaatcacaccattgtactccagcctgggtgacaacagcgaaactctgtctcaaaaaaagaaaaaaagaggccaggcacgggggcttaagcctgtaatcccagcactttgggaggccgaagtgggtggatcacctgaggtcaggagttcaagacctgcctggccaacatggtgaaatcccgtttctactaaaaatataaaaaattaactgggcgtggtggcgggcacctgtagtcctagctactcgggagactgaggcaggagaatcacttgaacctgggaggtggaggttgcagtgagccaagatcgcatcgctgcactccaggctgggtgacagactgagactccatctcaaaaaaaaaaaaaaagaaaagaaaagacgtttaattgactcatggttatgcaggctctatagaagcatggtgctggcatctgc

SEQ ID NO: 10796 - DNA, 13706 bp, Homo sapiens
agtttttctggggggtgatgagaatgttctaaaattcattgtggtgatggttgcacaacccagtgaatatactaaaaagcattaaattccacactttaaatgagtgaattatgtcatatgtgaatatcatctcaataaagctgttatttacaaagataaaaaagataaaattatgggttctaatgcatcattaagggacagagaggagatattttccagaaaacatgcttgaagcctgctaaggtcagattatttaattaattagtcctaaatatcccaggcatctagaacctaacatatgcaaaactgaactcacaatagcatcctataaatctgctcttctccgctacctaaatgaataaatagtctcattcgtcaagtttcttagaccccaaatctaggagtaacccttggggtcttctttttcccttaaaatcacattcagtcgaacagcaggccctgttggctttgcccccaaaataaataaaatctgaagaccttcttcccacttccactctgatcactctctccttgccacactcaccttaatttcaggcctcttaactggtcttcctacttgccctcttgagccctcactctcaccccagttaatcctccacaataatagagtgatcttttaaaattataaagtgggccctatcatttccctgttcaagcccttcagttgcctctcatgacacctagaatgaaatctgcaattttttattaaggactgcagggcccgacataatctggcttttgtcgctctggccctacctcctgctctgcctccttctttctagcctggctggctgttttgcacctccatagcaggcctgtgcatgttgtacttgttccttttgcctgaagcacactcccccttctataccatctttctttagtctgttactcttcttatttttctgcatgaatttatctgcctgacatttagtatatgtttacttggcattatttgcctgttttatctcaacatataaactccttaagtgcaaggactttgtcttgctcatggctatattttcagtgcttaggataatgcctggcctacaataggccaatatatatttgttgaatacatatatttttaaaatgcattaatatctttgaagactttttcttttttttcctttagtgtttgacttgttcagtgctgttaggttccttattttagtcttcttcagattgctctagttatatttctctgggttggaattctccaatttgttggggcttgtgaggtatcactcaccactcacatggtgctggattttctcatagatttcataacttttagtagtttcttattccttgggggctatctttcatggatattctatgatataaataccctgggttgtggctctcttcttggtggctattgtcctaacttcctgggtacactgccacttaaccagatctcagctgttttgacttggaatattatgcacactgcatgggtagcacacctccagcagggctctgcaccctggacagatctaactctggacctgtgtgggtggctctgttttcatgcctggggcagatgggtgaagatattttggcttctgtgcatggggaggcagtatattttctgctaccggctttactcagaggggcctaatttcagttttccgcatgttgtatcttgaggcttttgctgtcatttgggagcagatgttgaaaccctacctttgttcctgaggcaaagctgtcatctctattttttcatcccctcactgttcccaccaagagcttaactttagcttcttcttgcaatgtgttcctatattcaatttctgctccttggaaatcttacccaccttttttatgcttaagcttggctgtatatttttcatttatagatattgcccggtaacactttttaaacttttattttaaattcagggacacatgtgcaaggttgttatataggtaaacttgtgtcatgggggtttgttgtacagattattttgctacccagatattaaatctagttatttttcctgatcctctcccgctcccaccctccaccctctgacaggccccagtgtctatttttcccctctgtgtgtccatgtgttctcatcatttagctcccgtttataaataagaacatgtggtatctggttttctgttcctgcattagtttgctaggggtaatggcctctagatccatccgtgttccagcaaaggacatgatctcattcttttttcggctgcgtagtattccatggtgtatatgtatcacattttctttattcagtctaccattgatgggcatttaggttgattccatgtatttgctattgtgaatagttctgtgtttaacataactgtgcaagtgtctttatgatagaatggtttatattcctttgagtctatacccagtaatgggattggccagccaacacttagctatccaaaaagcaggtggtataatccctagttacttttgcgtgctttttttcatcccctctactaggatgatatataggatccaagaccctatatatctattgggtcttggatttttacatctttttcctgcccatactctctgatgacttctctgaaaaggacactatgccttcaatttggattttggcttgtaatttctagctgtgagaccagtaatcccttctcctgacttcaggtgggcattggtccctgtgcccaattatagggcctattcccaaacatgggcatatggattttgcagcctcatccctgggtcggaaccattgtctctgtatttttatctgtgccgtgagaatacttagccgatcagcctctttgctcaggcttcagaaagatgtgtggatgaggactttggagagacactggctaattctgtgttaatagctccaattctcctctctcaaataccaatgcctttgtcctaacattattgaaatgagtaaaatgttattatgaaaactgtatccagagtgtgtttagatggaactagaggggagtatgtaagtatgtttgcaatctgttagagtaacccagatgtctgtcatgtttaaaacttggaaaattttacctactatctggattaagtgagatgctttggcaactctgaatctgaattcttgcatgaagaggttggctggagcaggcagcagctaccctcttcagactatatgtgtcctcccagttttacacagtttccaggagattcacctcatctcactcatttactgacctgcctgggctcttttggcatctgcatttttaaccttgacaggaactttggtttttaatattagtgtgatttaatttcaggctgaggaatcccagcgatgttaggtttgcttaaatcatttgtaactgagatatgagaaccaaatttgcattttggaaaggtaggacatagtgtgaaaggcggtttcacgaattctatattaaatatcatcattgttagtgcttgacctggtttaaatattgagtcactgttggtatgtgttaccttggaagctgagtttagaactaaaataatgggaaatactacagttacgaatcaaaaaggttgacttgcagtcctaatcttgaagactttgggtaatgtagaagcaaatgaatatgagaaatatgaggcacttagaaatagaaacaactaagataagaaaagtccccacatatgaccagctgagaagtagagtacttacttgcggttctctgtgaaattactgaaaaataagcaaacagaaatccatttaatttttctcaaatagaaaacacatagtattatctaatatattttgctggagtctgtgaggggaggacttgggtgggcagtgaaggaggtattccaaaccaccctatagattatttggttttagattagttttataatgcaaaactagatgtaagatttagcagtgatgatgtaatgacgaagtcaaaggtagagtttccttaaaggccctctccacttattggacctgaacagctttgggcatagtgttgggaaaagaccactggatccttgcactataatgtttgaaagaacactgaaggtttctctccatttagacatcattttggatttcatctctctctctctttctctctccacccccctgaaaattcctcctacttgttatttcatagtattgttcagtttattgttgatgaatgctagcttagtcccacttttaattagtattttaaaaaaattatagggcaagcagggtaataaggaagcaagagaagaatgggaaactcaaatcactttgacagaagtgaaatgaaggggaccatagagaaccaaagaagaaaaagagatgttatacttacttatgggtgccatgggtggacctaaaaaccaaattagatattggtgaagatttctttgaaagaaacaaggttccctctagggaggtatatttgtgtaggggagaaacttggacacctttctgggtctaaattatgattctatgactatgtattcttgagtaagtatttggctcagtttcttatctcttacaaagggattggtggaattattctaaggattaaatgaggtaatgtaattaaagcacttaaatagttctagaggagatacaaagtaaatatatgtttgaaattatgtaaatataacttctttctcagggagaagctggatgagcagaaggcagaggaaactggaagctttgagtcaggtagctgcacacagttagaaatgagcagggtagagacaggtctctaagccttgcagggaacaacaagaacaacaacagaaaagagtagaaaaagaaatggaacttaccgcggggtgctgaaggtggaccagctgaaaaacagagaggtatcttagcaactgttttttctcccatgatattttcctttctatgtagagagtttcttcttggtaggtcattataacaatagggaaaactttccctttggtattcatttatttttaatatgaatcagcagaatgtgaactttcaaaaaatcattaataacttcatggaattttgatgataggaaagtaagtggttaaagtagtatgcaccccaagcctggaaatcttagctgtaccagggaaaggagagattccagaatcctacggtggtgaaaacatggacatactgatggcaagtgaaatgaatccagcttgcaactagaccagaaacaattatctcctttttctttccccattgctcaaattgtctttcagtttgttaagtcccttgtaatatatcattttgacctgctgataaactttctcccctgccctttattttttaataaaatagtaagtttgattttttccatagagttatttaaaaggtgagagaatgatgtgtcacatgaaagcaaaacacggaggaaataacaacttaaagttgttatttaaagtttaggcttaaatcctctaaagtctctaaaaggtgatacaaatttttcttagatgttttggaatttaaatgtggaaaaaagagaccagatatggcaggaggttcaaatgaaaaagggttatagaaacttcttatctactcctttctctcctaccattttttccctttttaaggtagtctcttgttgatgggctttgaaattttgtaaaatttttttctctgctctgacttatctcttccctttttgcagtgactggtaactgcttgaaatcctgcaggggattgtaaattgatagtcttaaaactttccagtacatcatgaataatgcagagaggttttgataatgagacagcaagaggccaagatatatctcaagccctttgtatcccaatatgggcagataaagactcttggactccactagagaccaactgagtcctaaaggagagaattcaatgaacacatagacttactgattgtgtgaggatgcgatctgactgaaaaacaagcaaagatactttttgttacccctttcttgtttcttttcctactcatttttttttctattggtaaatttactagtgatatacttgcttgaacatttttttttwaatcaaaggcactagaaatttccagaaaactaattatcagctggttgaattctggataatggaaaaacaaaaggctgagaaaatagaacttcaagttccatgttgcaactcaagttccaatagacatcagtggactttgataartgcaccacagagaaacaaataaataactgactaattgcctgtatagatgacttatctagaaagcagaaatggatctatatcatttttctgtcattttttttccttctgcatggaaagttcctaacattctttagagtcatgtaaaaacttttttctcaggtctttattttttatgcgagtcagtgaatgttctagaaacttattaataatttatttatgcctttctgcccatggatgccacggaagaagcatcattaaagtctctcttctcctggccgtcttatctaagtcagagtctcctaaagagccagaacaactgaggaagctcttcattggagggttgagctttgaaacaactgatgagagcctgaggagccattttgagcagtgagggacactcccggacagtgtggtcatgagagatccaaacccaagcgctccaggggctttggatttttcacatatgccactgtggaggaggtggatgcagccgtgaatgcaaggccacacaaggtggatggaagagctgtggaaccaaagagagctgtctcaagagaagattctcaaataccaggtgcccacttaactgtgaaaaagatatatgctggtggcattaaagaagacactgaagaaatcacctaagaaattattttgagtagtatggaaaaattgaagtgattgaaaacatgactgaccgaggcagttgcaagaaaaggggmtttgcctttgtaacctttgatgaccatgactccgtggataagactgtcattcagaaataccacagtgtgaatggccacaactgtgaagttaggaaagyctgtcaaagcaagagatggctagtgctccatccagccraagaggtcgaagtggttctggaaacttwggtggtggtcrtggaggtggtttcggtgggaatgacaactttgatcatggaggaaacttcagtggttgtggtggctttggtggcagctgtggtggtggtggwtatggtggcagtgaggatggctataatggatttggtaatgatgggagcaattttggaggtggtggaagctacaatgattttggcaattacaacaatcagtcttcaaattttggacccatgaagggaggaaactttggaggcagaagctgtggcctctatggtggtggaggccaatactttgccaaaccatgaaaccaaagtggctattgtggttccagtagcagcagtagctatggcagtggcagaagattttaattaggaaacaaagcttagcaggagaggagagccagagaagtgacagggaagctacaggttacaacagatttgtgaactcagccaagcacagtggtggcagggcctagctggtacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttgcacccatgctgtttattgctaaatgtaatagtctgatcgtgacactgaaaaaaatatatatttgtgttctgagtaatggaaaaataagggaccaaggaaattggaacattatcatatcacaatgtggatgcatacattttggcttaagatatgttagacactgctggagataattgagtttcactcatgaagggaaatggtcaaacttacaagaggatcctgtagctgaaaaacaaagataaatcaacgtgtacagcctgctgaaagaggagctagttttcgtactactttcctgaaaggaaatatcagaaatggcaatggaagaaacatccttcttagggcaagggcatagagcgctgtgctggggaatatacctgccatcatgccttgtggggattctgccttctgcttagtataggaggctgcaggaaagggagatgattgatctcttccctttttgcagtgagtggttactgctggaaatcctgcgggggattggtaatttctttaaactgtgctgcctttacctttcttctccctatttctgccatcctgtgaaagctttcatttattcatacaaatatccttcccttcccttgttgacaagtcactataaacttcgggtagtttccgaactttatctctctattttgggtttggtattctcctttattcattccttataggagtggagcagcagctaaatagaggaataagcaaaagaaatgaagaaatgtgagtttctacacacacaagacagaaatgagcaaagaggaaaagtatgccaggccctataggaagccaaaggcagctatcatacaatagacatggaacttaaccagtcatttctgaagtttcatctggtggtaaaaaacggaaggaacacaaaatggagaaatcaacatgtgtagaaccaagtgaattcagttctcccttgataggcttaaagagggtaactgcagagaggatatggggggccctaaaatctgacagctcagtgcatgtccggccttacgtgccttactttgtgctttgtagcctcagacctgtttctgctggtctgaggcaggagattggctataaagtggtaaagtgaggctttgttcttccttctcatttcatttaggaacagtaaatgcttgaaacacttctagaggttcataatgtcttaaacttatatgtacttttgtcagtctcattttctttttcttttattttctttctttcttttttttttttttctttttgagacagagtcttgctctgttgcccaggctggagtgcagtggcatgacctcagctcactgcaacctctgcctcccaggttcaagcgattacaggtacctgccaccaagtctggctcatttttgtaggttttttttttttgagacggagtcttgctctgtcacccaggctggagtgcggtggcgtgatctcggcttactgcaagctctggctcctgggttcatgccattctcctgcctcagcctcccgagtacctggaactacaggcacccgccaccatgcccgacttattattattattatttttttgtatttttagtagagacagggtttcactgtgttagccaggatggtctccatctcctgacttcgtgatctgcccgccttggcctcccaaagtgctggattacaggcgtgagccaccagtgcgccgggcctaatttttgtatttttaatagaggcgcggtttcatcatgttggccaggctggtcttgaactactgaccttaagtgatctggcccacggggcctcccagagtgctgggattataggcgtgagccactgcgcccggcctcatttttttgtgtgtgtgtttttgagacagagtctcgttctgtcgcccaggctgaagggcagtgacacgatctcggctcactgcaacctccacctcccgggttcaagcgattctcctgcctctgcctcctgagtagctgagattacaggcgtgcaccaccacgcccagctaacttttgtattttttttttttagacagagtctcactctgtcacccaggctggagtgcagtggtgagatctcggctcactgcaatctccacctcccaagttcaagtgattctcctgcctcagcctcccaagtagctgggactacaggcatgcgctaccatgcctggccaattttttgtatttttaatagagacgaagtttcaccatgttggccaggctggtcttgaacttctgacctcaagtgatccacccaccttggcctcccaaagtgctaggattacaggcatgagccaccttgcctggccaaatttttgtatttttagtagagacggggtttcaccatgtttgtcaggctggtctcgaactcctgacctcgtgatccacctgcctcgggctcccaaagtgctgagattacaggcatgagccaccatgcctggccctggcctcattttctttagtcactcttgttcactaaccttttaattaattaattatatttaagaggtacaagtacagatttcttatgtcatatatggcatagtggtgaagtctgggcttttagtgtacccattacccaaatagtgaatattccacccaataatttttattgacttgaaaagctttcttcctactcttctttactagggctgttgcgagccactaatttttgttaaagtcatttaaattttaatcagttcattttgcactttctccaaatcgcttataacttaggggaaagctagaaaggaataaaatagcaatatatttttcatttatacactatcatatttttaaattgtttacacataagggagagggagtcaagcggggagaaaagggaaagggaattcatgtatccatgtagattctctggcacatggtggctattagggaactgtggaccagatgtgacccttcctttagccccagtgagttcctctgaggtgagctggcttatgtttatcccccctgtaataattatgagaacttccaaggctataagtcttggcaatctgtgagtactgagaaaagcagtcttgattcaggggaatagtcaataacaaatggctcttattcattcacaaaaaggatagttagaaccagaattcagggcagtaaatatccagttttaatggtcatagtgtggctgtatgggatgctgcctgccctctacacattttgggtttgttttcccaagttatcttataggactgtaaactccatggcatcagtgaccaaccatatctttctctcccttattcatgactttatcctcagtgctcagcttagtatcagatacatggtaggagctcagctagatgaaggaatgtttgtttgaatatatgtgacttgccctctgataattcttcctgcttgacttaaactttctaatgctatcccttaatttctagattcagaatttcccgtgtcctggggttggttcgatgccctagtttgtccctagctcgtcacaatatgaactttcattttattctcttccatatgtgatgcttctgccagttcctgtaaattacagcccaattactgttatatcctgttccatgaggtgctctgtcctatctttcttttcctctctgtcgtgcgtgtgtgtgcgcgcgcgcacgtgtgttggggatgtttggagatagtgagccggataggacatgaggaaagagaaaggcctttggagagaagactggagaactcaggttagactagaccctgcatagtatttcctgttaaattttattgtcttttctcccttttgtatttattcttaaaatttgattttcttttctcatttcctcctcattgtctcctccattatctttgagtaggccctttagaaactacaaagcacttcagaactggaaagctgcccttattattctctctctgctactttagaaaattcttgtatattgttatagaagacattatgactatttctggggacattttcttactctttttcttttaaaaaaaatagccctggagaattctcagtaggttgaaatcaggaagcataaaaacatgtgtaaaataactgctcttatggcagtgagacacatctagggcatttgagacagggaacaggccctctagacactgtagaagatcaaggaacctggagggagaaggatagataaggtacttaccattggatccaggatattgtactaaaaaatagaaacaaacaaattaaacacacacacacacacacacacacacacacacacacacttctattttttgagacagagtctctcactctgtcgcccaggctggagtgtggtagggtgatcttggctcactgcaacctccaccttctgggttcaagggattctcgtgcctcagcctcctgagtagcagggattacaggtgcccgccaccatgcctggctattttttgtatttttagtagagatggggtttcaccgtgttggccaggctggtctcgaactcctgacctcaggtgatccttggcctcccaaagtgctgggattacaggtgtgaaccactgcgcctggccccaaaacacctctattagtgatattttccaaaggcaagcagtgaaaatgattttctcaggaattactaaatctcagtattcaggattaaatatttttcactgcactgctgctgtactctagcctctccataagaaccagatcttcttttaggagattattaaccctgttttagcataaccacttcattcttgcttttcattataggtgttggagatgagatccttaattgtattcctttccccatattcccccagtgtttttcctcagatcactctgtttcactctcagctatctttatgttcttgttcatttcttatattcttttccagattcgattacacctttgccttaggaagttattctaatgattactgacaagccactataatcattattagaacaatgcctatctattatgaattttaaggtaatggaatttccattttctaaaatataattggttgcccagagagatggttagtgttaatccaaactgcaccattttgtaagcctccagcaatttgaagaccttggtaaaagtgaaacattccacgggggttcgggctgtgagaaacattctgcctaaccacctgaacacaaggtggacaaagggccaactaaagaaacatccctgtcatattcagctgggagaaagtgcaaggaacactacattctgcaggaacaagggccagaaccccctcatcatgggaacatcttatcaatatcctgccggccagcaagccatactacccagacccctcccgcctatacctataagtacccccagcctgtaagcagcagtgggcactggcattaggctggttccccacttctgtaggtcttatgctggacgtaaagcctacatttgctgtacagccgccactctctctgtgtcttttctttaaccctcgccttccctccaaaacctaacagttacgatatggggaaatgaaagtctaagaaatatgattttcagcttctttaacccagatacttaaacagttggagccagtctccttcagacatagtaagaagccagtagagataagttgatatatacaggcagcttaccaataggtcctggagtttgcactaaaaagaaattcaaattggcatattagtacagttatttggagagtgtatttttcactaattttatcctagaagtgaggctttgagaggtagagcaggggagaggaagtgatatcagttatgagatcattagggagacttaatccaactatattaactatagaaaaaaggaaaaaggatatttagcatttactgcaatatttcagcccaaggtgaaggtttttataggatccttgccaacctaagggatactagggaaaggcaaaactttgttattaggtattaacattactgatggtagggaaaggtgaaacacttcctgtcagtaagagtagaagatatttctttctcaagggactgttctttcactaaaatctttatttctgatcaactaatatgttccagaggtagacattagaataggaggtaagaatctagtt

SEQ ID NO: 10797 - DNA, 16319 bp, Homo sapiens
  misc_feature (1)...(16319): n = A,T,C or G, or insertion/deletion polymorphism (see Tables 1-2)
atgacgtggacctccgtgacacacggaggcactgtgacaagggaaacctgcgtgtcaagccccaacagggcacagcagtcttctggtacaactacctgcctgatgggcaaggtgagggcctatggccaggcctggggggggtgccctgagtacagcttccctttacccagcccccgtctgccacaatggagggctgtttctggctgctttccaaatagttttctgctcctggtgcctcccaaaggccatccttagtgactttagcagactgccccaggacctgtactgcttattgggttatatccatccctatcattccctgatgccccagccttcctactccctggggcttgggacacatgtcccttgctaacccaggatgggaagggatatggacaggcccaacagcaagaaagctggtttcagagggccagtagtgttgactatacattagtgggctgagatgaggagcctccaaggaagctttaggtctgggtgtttgctacacaaggaatgcatagctggacccaccttggtcatgctcttggtgcctatgaggccaagctctggccagcccagcctaggatctcacgtcaccctcctcttctaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagagtccgcgataggtgcagcgggctggcagctgggagcgccccgcaagcgtcacgtgagggggcgaggggcgggggatgccccttccgcgggccccgccaatgatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttagtagagatggggttttcaccttgttggccaggctagtcctgaacccctgacctcaggtgattcatccgcctgggcttcccaaagtgctaggattacaggcgtgagccaccgtgcctggccgagaccaaggattttcttttttttttttttcttttgagacagagtctggctttggctttccaaagtgcccagattacaggcgtgagccaccgcacccggccgagaccaaggattttctaagattcaagctgcaggattgtgtgtcctgatgcattcataggctacatgccgagaagtttccctgatccccatctcttccctgtgggtcatcagagttaggtacctagctctgacatggctctttgcctctatctaggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatraccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcrgggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagygtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctyggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtaatatatgctcctgggcagggtgtggtatgggtcatgcagatgctcccaggcttgcaggctccacctgacagctgcatgttgtctctgcaggtacatgtcccttgctgtgtgtgaacttgaccagcccggccttggcccccttgtggctgcagcctgtagtgatggggccgtaaggtgagagcatagggcccagtgggacaggagacaaaggaagtaaggttgtctaggatgcgttctgagctgggccaccccccgccccccaggctctttcttttgcaggattctgggcggattctgcagctccttgctgaaaccttccaccataagcgatgtgtcctcaaggtccactcctttacacacgaggcacccaaccagaggcggtgagaggggctggatgatggtcctgcatgggctgggttggggggttcctgttgagcttcatctctgttattgaccaggctgtcttttcctggctctcaggaggctcctcctgtgcagcgcagctactgatggcagcctggctttctgggatctcaccaccatgctagaccatgactccactgtcctggagcctccagtggatcctgggcttccctaccgtgagtagctaatgtgcaaccatggctacccctcctcacctgtcacatagccctcacacatgtggcaggcggggccctgacaactaccctcttcctcttccttcagggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggawgggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccrttttgctrtgtgstcacccccaggatgtgtacccggttgtagtaggagctgaaatccatgctgagctgtaccaggaacttgcatatctagagacagagactgagtcactggcccatctstttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctggggaatagaagcacagctgcagagagagaaggcagccaccacaccctgtgccccaacactggccctgtcaggctcccaggctcacctgactctgtggggctgtgctcagcatctcaaacttgatggtggccacagagagaacaccaaagatctctgtccaggctgggtctgagggagtatagggttggtcagtcagtctgcaggcaagggcagggatgcaaaaaacctgcccctaacccagaacatagccagggtttcccaggcacaccttgtgccagatccccaccatgcttcagtgctgaggccttgcacacctgggtatgccggaacctgtgtttggaagagaggaaggccagtgggcagggtcctgggtaaagagtcccccctcattaccctggcttaggttggtgttcctcccagcctcactcactcgtagtactcaggggcagtcatcagagtgccaggtgcaccagctactttcacagggccacagatgaggtgcttctgtcagaaagatgtcaggggctcagcctagttggcgctactctccaggaagtcccttgaggagcccaaatctggtgcctctactcagcccagactccctcaaattggaactgccaggttgagtgcctccgtctacccagccactcaggctacgcatggttcatccttctcaacctggtcttcagtgttcttgggatgtgtctacagaccccccttccccagagcctctgcacctgctgtacatgccctctcaagtccagcaactcccccaaggtcaagtgttggtttctgtcagctaacaagcccctcggtgggttttcaagggccctctgaggttgggggttaggtggtggggagctccaccatcattattaacctacctgtctgagtggagccttgtcaaccaacttccgccaaagcaggtccaacttctgttgctggaactcctcctcacagctaacaacatgtacaaccaggcagccgcctgtaccagtatctgaggccccagcctaagggaggacaatcataactgtggaagtacagtatacttggtttgggagaacctacagggctgggagtcactaaccaggcctgggtggctgtcctcgggccaatgccatagagcctcttgcagctcagccagcacagagaggagatcctcagtcactgaaaagagaacagacaggtgctgagactgacaagaagcagagatgtgcccctaaccccctcctgccttttctggccctgctaggcttcaggtcctacccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccctgcgaagggagggcggccgcctcagtctgagcacctggtccagctcgccacgacttcccacctccagccgcagtccccacgggcggcgccgctcgctttctaggtacccggcagtcccactttctccattccggccccgcggccccgctcacccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctgcgggagaacgggcgtgtaaaagagccacggcacggggcccatctcccggccgcacggccccgcccggctcacgcccacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgcctggtcgccatggtgaccggaaggagtaagcggaaccggaaaaaaatttagggaggtggaacttccggaaaggaccgactagctggggcggggatgcggcggtggtccccgtaagtggacaggtgcgccagtggtagccctgtcggctgctttcgacctaccgcccccagcgccccttccgcgtggtccacctgcacagccgggccccggatctgaaatctcggggccctccctgggcctagggttctttcgctgtgacccaggccttaaccaggaaaaggatcctcgcgacccggtgggcgcttagaccgggtaccgtctcttctcatcgaagtctcacatgtttgttttaataacatttcatttctcccattttacacatgatgaatattcgtcactggaataaggcagtataacattaaggccactttcacgacctacttaaaatatctcgttttaaaaagaatagtgttccgcggtttcaggttatttgcaagcattttctcgtttgagatatgggtgtttttttgtttgtttgagacggagtcttgctcttgtctcccaggctggagtgcagtggcacgatctcggctcactgcagcctccacctcccggattcacaggattctcctcctcagcctcccgagtagctgggattacgggcgcccgccaccacgcccggctaatttttgtatttttagtagagacggggtttcgccatgttggccaggctggtctcgaactcctgacctcgtgacctgcccgcctcggcctccgaaagtgctgggattacaggcatcagccactgcacccagcccgggtggtctttatgcccaataaataagcactctgatacagttggcggttttcttctcttgatacctgagaaatcacaaccatcatgatggcttccagaattaccagactttttttttttttttttgagacggagtttcgctcctgttgcccaggctggagtacagtggtgtgatcttggctcaccgcaacctccccctcccgggttcaagtgattatcctgcctcagtctcccaagtagctgggattacaggcacgcgccaccacgcccggctacttttgtatttttaatagagacggggtttctccatgtttgtcaagcctcgaactcccgacctcaggtgatccgcctgcctcggcctcccaaagtgctgggattacaggcgtgagccaccgcgcccggctcagaatgaccagcttttaatgtgactcctttaacctggtgtgctttaacaacgatccttaaagcttcctgttttaggcaacagccatttacgggccaaccaaataatgcgaccataatagaaaataggcctcagttggagtatcttgctcctctaccaataggaaaggtctttttctttctcccacaaaggttcccaaatgtcttcatttcactgtaacttactcaccccccaccccacccccattccttttaatagagaagctaactcagtagagagagttgggaaatccggagagcagggaaacccaggggcaggaaaagcttggcaaggcccctttctgggccagggctgaggccctgctgggaggcgccgaaagagcactgggcggacacgacattcccgatggcttctcgggtgcccactcaacgggagtgatcgtgtcattccaaagcgctttccattctgaaggtgcatgacctggagacaactgcttagcagggttgggaaccctcagtcaaactgaggacttcagatactctcatccacgaagacggttggggtggtttttccccaggaagtaagagggctatctttagcgagatgcgggctgaggcagccctgggggagtcactaccattgcagccctacccagaggtcctgggtccaccctccctcgccaatcctccccagggttccagagatggccaccagcctcggctctcccacgtctacacccatcacctccagcctgagggcgcaactgagaggaactgagacccaagcagctcagtaaagtatgtctgggggtcaggggcaccccatctgggccagggcgctgctcaggcaggagagcaggggacgaaatccaagcgcagctggaatgctctggagacaacagctgcttttgggattccgttgcccgctgtccagccgttggcggggggcgggggagctcctgcccccaggtcactcgccctggggccacatcagaacccgcccatccccagtcccaggaggaagacccgggagtaggttgtgaaacggagtctagagggaacaagacgctcacctgggccacagaacaatagaaggggaggtgggggcctcccctgggaccgggtcccgatccggattagatccgtggggcaggattagccctgttggtcccacgaagcctgggccactggtgcggtgacggtggtggggcgggcttcggaatccgtcaggagggaagcgcgcccgtggggccggagaggaagtaaacccgcgcgtccacctcggggacacccccgcgctcggtggcctttgtccggtgacgctgccagcgcccggagcaccaggggccgaaggggtccacagagcagccgcgggacccccggaaacccattgcgaccggccccaggagacccaccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccctctccgcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgaca

SEQ ID NO: 10798 - DNA, 293625 bp, Homo sapiens
  misc_feature (1)...(293625): n = A,T,C or G, or insertion/deletion polymorphism (see Tables 1-2)
gtgatcacggggacctgggtgtgaaacctggctgtatcactctgagttctaggaccttggtaaagttattcagtctccctgttcttgaagccatctctttgtccaacaaatatagtccatacctcagagacatgctgtggatgatcccacaaaagcctacagtttagagagtaggctcatcatatattttggctatcattgtcattagaattaattaaaatagcctttgttaagtcttttatttctcattcatattcctgtctattacactatttgtggacttgctcttacttctgctacagatggtgactcagaggggcaaaaatccttgttgaagggcagaatggcaaccagaatgcacacagcctggtttcatgatttgtaaatgtgctttttgtcattgaagattctgtggcaatgtcccagaggctaagagcaaaggtgtaagttttagaccttgtgaccccacttcaaccaaagcagccctgcatttacctgtcatatactgggggtttgccctaaattcatgtaatgaatattttcatcattaaaaataagtttaaaaatcatgatcttagaatattaatcttggacaagtccttgtaaaatgataaacagagaaactaagaaaagtttccatttattgaacccttaatatgtggaaggtactatgccaagagtttgccatatattacctcatttgaatgttgcaagagccctgtgagacatagtttgtcatctccattatatgaatgacaaagttgagggctgaaacgttagtcacttcttagagtggggaaggaggaggttagtgggggataaaatagagaagctaggtttttaaaacaaagcatagaggaaaaaaatatttaatgactgtagagcttggcaacatccctttcaatccttgtccaatttaccctgtttgagcaaaccagagaatactcatattgtgcacctttttcttccccacaaagcagtcaccttcctgaaatgcaagggccaaagcacgctgacttacatctcctgcaaatgacttgtatgcgcacaaagccagaaactcttcacttggttgtctaggactgaataaatcttcttcagtcctgaattgggcttgcctggctgggatggatagtagttttcctttctaaaacacatatgggaaagctctgtaaaaatgggggaaaaagtctacaaaaacatgaaaaagaggcattcattcttcaagtggtgctccctgtcctgccctccctccggacagaaagcttttccaaagagtttccaacagcatcgtacttcatagctgtcagctttagaatctgcagatgcctaaactcaaaacctcctgacattctggaatcaaaatttgacattaacttccagccccgggctactaccttttctccaacctgtgccaacacaacctcctgcttgtaaaatacagccaagtctcagacctgccagcctagtgagacaccctcagattgggtgagataaaaagcgggggctgggggcgggctgaggaacaacacacaagaaacaatccaagactggctcaatgcctcttttaacttccagagtgatggcagtttttggcaatgacaatgattatccaaacttccagttattaagcagtcattgctgatctttctatacctcattttctcctcaaaacgacagcagacgctattgtccccattttagagatgtgaaaactgaggattaaggaagtgatgtatctttctcagggtcatatgtatggtggtggggagaataccaaacacctctggcttcaaacctaagctcttattcctcttacaacactgatgggtgagaagaacccctgtgttctttccaaagtacaccaggggcagcagggttcccatacctgggggatgttgttgctcagatctttctgtgatgagaggtgaggaggaggaggtgattctagagacatgtgggacgctgctggctctaggcaccccagtaaagctgttctccaccactctctagctgcctgtcagttattcatctggcccaggagccacctcctctcttctgtcccccagctctcatttccagggtgaatattttgaggaccaaatgagggaatgggtacaaaactctttgtaaactttatgtaagtgctgtttagatataaacttttatattctccctgcactcctctatcaaactccctctaacccatcccaggggcaggctatgagcaaagtctgccttaaaactctactgccctaaccctcaaaataaaagatatatacaggtgaatcagccagactagaagtaggagagcagttgaagagaaaatttttacttttcctctgcagaacagcagaagataacaactttacgaaaagttccttccaagtctgactattcataaagttaaaacaaacaaaattacaagaccagaaaagtcaaggtgcatctgatataaccaatacacactccttttttttccagcggtggaaaaaaaaaccccatatgttttgtaattataatataaaatcacaactcatttggtaccaggaatgcaatccttacatcataaggatctctagtgatgagggcaaaacagacttacctttccgatgggcgagagacctaggtccttggaagaagtacctggagtgtggagctgcggcggttcccacgtgcgcgttcccccgagttccccagcagcgctgcctttgtgcccacggaggcgggggcgtgtatctgcgcgcgggagaggcgggtgacagtaggcaggctgtggccggtgcagccaactttggctggcttatatagcgagctccttcctctgtaatgggacgcctcgcctccagacatcctttcccactttttcagttggcgaattaaaggaacagccctcccagcggaacagggttagctcatgaaagacgcactcactcctggctctcggccagggaaggaacccatttgcatacaatttatggcgaaagtaggaattcccgcctgcccgcccccgaccccgagtagctgttagtgaaatgtgatttttgctttgctccccacacgggttttctaattgtgagacggatgcctggggagcaagagggagtaggatccgcagccctggctcccctcttgtacttggtcaagctggaaatgggaccagggctcgcctgggctctgggcagcagctgctcagtggcacctcggagcgagtacagggactgagcccagttcctggaaagaggagataaagcccttcaaaagcctggggggtttcaggtttctctgggccagcggagagataacccaggattaggtctcagcaggtggggatcgtgcgggacgctcacatcagccctgcttttcttgtgtgggagccagccttgcccagctgctgggaggcatctttgttccagccccagtgtcctgcagggcagtagctttttgacattgttcatgccctgtgcctggtgtggtcttctcagctgggtctccagggggaaggatttctgaggttttctcttagtgctgaaaggcgtcccccacagccctttctttaaagaaaagcaataatttaaaaaggtaacaacctaatccttgagccataagctgcgcctttgctttccagcctgccgtggatttcctccaagctctgagtcatccgttcgtttggtggttagcatgcattgagtatcctcagggcatacaggggcatttaagggagtggagaagtagcacttcacccgtgcctagagacttctgagcctgccgcagagcatagtagtttgtgacagtgaagtaaaatgaagcattaaatgtaattcaaaacgcaactaccattgagccctcccttattaagtctataatcaggtgctgtgcagggtactttatgaacactatttttgttcactatttttattatatccttgtaaccagtaagtaggatagacacaagtgtctcttttttacacaagaaaactgacgtttagagaagtaatgaaactttaccaagggaatacacctgggaagtgtttatattacaacactgggctccagagatctattacacgttactgtttaggaatagggtatgatgatatttaaacaatgttttatgctgtattagattgttaacaccatttgtgtagaaatcacagccatatttgaatatggaaaatatatttatttgctccataaagctaattaggagagatctttgatttttaaaaattaactactaataatggaggtctcaattatccacttattttcaatattaaatgatatcatccccacagttattattgttgctgtgggcctcagtttccccatctgaaaaaaaaagcaagacacgattaggtcatcctacggttgctttggctgtagtattttaggattctctgctaaagtgaccctcccagacagcaagaaagcccataaatagtcatgtcataaaaccgctcatttgaacttttgatccattttggctgattcaaatgttggttgtttgggaagttttaaattctgtgctttagccaaaggatatttcagtagcatgaagctgtgtctcaaccagcagtgagtggttcctactgagttaatctcttgggttagggattaaaatattagaatagtgtacaatatatgtcatatggtatataaactatatttgtatagaacatataatcaatatatttataattctatgtgagtttttaaataagacaagagcgcatgctagaaaactagatagatatggctttttcggggaatgtctcaaactcgaactcctctccccagttctttaggattctacaatcgttgattagtgtctaccacaagtggtatggtcaatcacagggaaactaagccaaatatgaccaggctggccctcaaagcaggaaaaggctagcagaggtgacaaacaagaatactattatgggttaagttaacaactatcatataagtgtattctgataacatagagaagagatgatttatgcatttttaggagaggctacttgtaaaaggcattttctccaaaaagctatgtggcatcttaagctttttggcatttgagtaaggagtgcccagacgaggacgtgttttccatccctgtactgttcgcagcctctgtttctggtagatgggtccatatgcaccaggtactctacaatacccaaactttgttcatgctaggatgatgccctaggctcctcacctccatgccctcacatctatttatcatccatttctgatctgacttcactatggagcttcctaaatggaagaaatccatctaggaagagatgtttctatgcactatggcatttgtaactctattaggacatccattgcatctacatggtataattacacatgtgcatgtctagattttcctcctagatgctaggcttcctgaggctggtgatcacacttgctttttctgtacctggcatagagccttgggtatcatagaagctcagtaaatgtttatagaatgaatgaagtaatggaggaacaaataaatgtttgacatgttgtgctttataattaaattcttccttttacaaccatagaacctgaaaaggaaactggattattgtgtccaatgcttccatcgcacagatcagaaagtggggtgctgagaggaagaatgacttgtctgaagccactatgcctgctttccaggaagaaaactgtcacaatcagaactgagcaaccaagccacactagacattacagcagaggaagtttatggaaatgaagaaccatttttcctcctgtttggcagaggccatacctcttggcatctaatccctcatggttgcatccttctgagaagcataagcacttttttccacttgagagggtagaatgaatgcatgtaaacaccacccctgcacagagcttcctgccaaagactgattttgttgttgcttgtttgcagttcttattcaggagttgctggtggaggctgtggtttagagaccagaggaatgtcatggtttgcctcaggtgagatcattctcatttctttaaaggtctgttaaatgtaatactttttcttccagacagaacagacaatgagtggaattttggccaggactagtgctgaggaagctgagtgtccacttccccatggaatcccctgcttcctactctgattacatactccttcactgttcccaaccttcctcctcctcttcccgggattcatctcatctggtgtgctaactccagtccaaaagtctcatgtgactccataattaccagaaatcttttccaaagccgggatggatctctgatcccacacagtgggccagtcatttaattaaatgcattttgttagagtcaagktttcccaacttgcttgcagatcattgttgagtggtcttttccaactcttcttgcttttccttcgacaacaaaggacaaaatcaagttcaaagaccatatggagtgtgtggcaagacatatgagagcttctctgatggatggactatggcaatttagctgcgccatcaaccaagaagtcatgcctggtcagcacagcagagtggagagcattggttgagtgtctaagtcttgatgctgcatcaactcgctgtgtgactttgggaaaatcgctttccccgctgacacacagggtcctggttagcaagtggggaattcccagggattatagcaactcaaaactctcaagtaaaatctttaaagaaataatttagaagtctccaagcctttgcacattcacttccctaggaagaaccctgtcttattgccatgacaaattcctttattatttttttcaagagttccttcatagtgcttcttctaacaaagttttatgaccctcacatccagagagaagggcctctccttcatgctcatctacaccaccattttttaacttttagtatgttgcacattttatttctcttgcctgtttaccctgctagatcatggacacctgagggtagacactgtgcctttccatctgtttgtcagcagttctctttgttgccagcatctgttgatggctgctgcctatgtcatgttatttgttaattattttgaatatcattcctacatatcatagtgtttagaatagcatacgacctgtcacagattttggaggtaagcaataaaggcattcttgaagtgacttttatgaaatgattagagaccttaattgttatcatcaatttactcattcatttgcccagctggtctgtgaggactccttgaggccaaggactgtgcttttcacctgtacagacccaaagcacttggaggttgattaatgttcctatgaaatgattgactgatcaactaattggctgcataatggaaaatatatgatattagcacacagtcttgggttctatttggcccaactgcttacaatgtgaattaccttgagaaaagcatgtcccctctctgaagctcctcctcttcttcttgggattcatctggtttcctgttttataaaactgagataaaaatctgtaccttgagtacctttcaaaattggtatgaagaccaagtaagagggtgtaagacaaagtgcttagtaagctgggatgccctatgtagagttttttgatgctaaatgatgtagttcccttccccgccccccaccccccaaatcccaacaaaaagctcaatctctgcatagctatattgtgtttatgaaagcacggaacccagcttctatctgaagcacttctgggctttgcaggggctggcagcagggagaggggagttgaagcyacctggtgctgtcttgttaaaatattcaaaaggctgcctcttcggaggttgaagggaaagaggaaaagtttaaaaaactagcattgcccaagctaaattagaagatgtggagttgtatatttccaacagagggctcggaggcagttttgatcatgtttaccggtctgagctcaggctgaggtgatgaatacaaatggctcaaaccatcttgggcttaatacaggtcacagagggaatatatagctttgaaatcaatgcaaattgaatttctttctttgattttccacagctgggttggatacttgtgaggaagtataatttgcttgttttccttctctcttaggtttcttaagatttcttttgtggaccacaaagaataacagtggctaacactgattgagtattttctgtgatctaggcactyttgaagcagtttggatgtattaaattatttaatctttacaatgagcctttgggttagtcctatcattgttcccattttgcagatggggggtgtgagacatggagaggttagggaaatgtccagggtgcatgggtaataaatagtagcaagaggattcaaacccaccaaraggactccagctcccagttgtctattattatgggtgctttcttatgtatttaatgtaacaattgcccaaaggcaaagatggcattctttgattcatgaactagattgagtgatttggagcttgcacataaagatctgaggaggcaaggttgtctttggttattttcctttgtccctgtctatttgtgccaatcctggagttttgggattacctagcatgcacttggtttcaaaccttaatttaaccaataatagctacaaaaaggagtaggaccttgggtaaattacttaacacctttcttataagttctccatctgtaaaacgggtacaatgataactgatactccttggagctagtctcaggattaaaagaacaatacttagtcaaatgcttatgccgttgcttgccacattctaagtaatctcaaaatagtggcctttggctattgtagataagtcacttattctactgtgagcctttactttctcatctgtaaaatgatggaaaagataatgtcagaggtatgtttcagaaatgtgctcactaaaataagaagggttaataaaacaaatgtacatgcaaataaaaatatacagctcttttcatcatgggacataagattttcagattgaccgaactgtactagtcaccctgtgtgctctaatattcttcataaatttcccctccatcctgctatacacatgcagtacacatgcacgcacgcacacacacacacacacacacacacasagagagagagctcattgaaatgagtattttactgaagggatgtttagtattgctctgagagagaaatagtttgaacttcctttgaaaagtagaactacatttgcccatccagtcaatagcaggcattattatttttaatcgtctttcaagccttgtacattctgtttctcaggtggaaaaatttaccctatccagagtcagctgggtggtttcacttgcctcagagccagaagctccctcggcagggcctagaggttgatggattggcatcacataggtatttgagtcactctcctccttgggaagtactctgggctggccctttgtcccttacccttcctaaggaggagagtaaattgaccctccttattttagtgagcacatactaggcagtcctaaccttgactacttccttgccccacagccttccaatggtaggggtggtgacaaatatacccacttgtatttgctaataacatgacaaggcattggcattatctcagtcctcacgccaggccattcccctaatacaagtgagaaagctgaggtgaggagggatcaagagacttgctgaaagtcacacagctkgtatgtggtctcacagaaggtccgcatatgaaaattactgagctactgggctcttcaggtttccattacagaaccatctataaagagtattattttatcagttttatggggtacagtggtataaagaagaagctcatgatctgatactagacagatgggatcaatcttagctctaccatttattagtgtttgaccttttttcaatttccttcacttatgtgaccccatcttgtatctgagtctgtaaaagaggagtgagaatacttaytttacagggataaaggaagggccatgggaaactgagtaaggattcccaagatgtgtgtttgaatccatggaatctgtgaatattatcttgtatggcaaagaagactttggagttgtgactaagttaaggatcttgaggtggggagactattttgcatatacttaaaagtgtctttataagaggaaggcagagagagatttgactacagaggaggagaaggcagtgtgaccaaggaacagagattggagtgatgtggccacaagccaaggaatgccagcagacaccagaaactgaaagaggcaaagaatggattctcccttggagcccccagaaagaccaggcctgttgacaactggattttagcttactaaaactcacttcagacctctggtctccatagttgtaagagaatacatttctgtgttattaagtcattaagtttgtggtaacttgttagagtagcaatataaaactaatacaagaaataaatgggaaagtatctttgtgttgtgcataacagggccttaaaaacaggaatgcttaacttgaactcatggagatagagagcagaaggatggttaccagagtctgggaaggttctgggaggagggctggggggtggggatggttaataagtacaaaaaataattaggaagagtaaataagatgtagtattttgatagcacaacagggtgactatagtcagtaataatttaaatgtacatttaaaaataactaaaagagtgtaatcggattatttgtaacacaaaggataaatgcttmaggggatgaataccgcattttacatgacatgattattaaacaaaacctctcatgtaccctgtaaatatatacacctactatgtacctacaaaaagtaatgaatttttaaaaatggtaatggttagtattggtccaagagattattttctgggagaaatggcattaacttaccttgaaactggaatgcttttccatagagatgtagttctatgatgtaaatgcacattgctagattttcaagtagttttttttgtcacagctcctttaacatgacattttagttgtaggctgaaagacagagaaggaaagggaagttggagggagttgcaacctccatcattagcccgacagttttgaagtggcctgttgacatgggagctttgcagtgtcgagtggtttagcccacagtgaggagtaaatctggacttatacatgacattcctatcattccagggtcagtctgaacccagcaagtggcaggcttatctgggtccctgctcatccataattcagaggattcacccacagcacactttgacaagtgtgaaaagagctatgagacaatcctgctcaagttagagataagaaaatggggcccaaagcagttgcttgtcttgcccactctgagctaaaatccaggtctgctcatttgtgaaactatgttccacatggaggaagaagcttgcctagattggtgtagraccagccaaaatcaaaggaatttattgcttaaaaaaaatcctttacacggattgggcttcttcacttagaaaggacataaaaaggggaccgagaggagtaggtgaacacacaccaggctctctactccctctgagcttccgtgagcagtataatgttgcttctctctctctcctgcttttctccggttttggatgtgtgcagtgctctcatcgatgtggctgtggtatcagaggaccaaagaagccccctagtgagatgccaggcaagtttttcagacactgtatcagaaagcagcctctgtaggagaacttcaaagactttctaaatgctttggaacacctgcccaggcccacattgggctcaacttgcagatgaatggtatatggggagtgctcttgggtgaatatagatagatgactcatcgtttgagacagatgatggatttcccttgtggaaatactatataaggaaattatggtgaaagtttgataatccccatggacaggagtgggcaggggccaggatgaatcagtgagacagctgcattgtggaagaccaatccagggaagcttactttgaagtatattttgccagtggctcctttaaactagtaaagtattgccaaggagagatcttccgagagtctggcttaatgagcagaaatcagtcataagtggttgcttttgaaggaagtggaagtactttggcttttagcaagttgcaatcttgtttgctcagttaatctaagaagtaattcatatgaaattgctcctgttcagccatatttgacctacaaaaatgatactttaatatgattaaacttaatacagtataagccctatcaccaaatctgtgacaaagacaaattccagaccagaccttggctaaatttaaaaaggttttgcccaccgtcactcttgcgatggaaagacaggccaggttggtatggggcagggtatttgtgaaggacagtgagttaaccccatgcttgcagttctgacagccatggttggcagatgaatttttttctcccatctgtggatactgtactgatatcaacaccatggtagaacctaggtagagcaggaagacacccaataaaagagatgtcacaagctgatattgtgtatcagagttcaggtttaggcccttagagagccatggagatgaccagatagcaggggtaaaaggcatggtgttcttgagactacacctgggcaaacatgtgaatggatagttgctatctaatgagccccatggaagggaatggagttttacgctatcacttctatgacacaggggatcttctgtaaatagtgattgttaatttttattgagcatttattatgtgctggataccatttttagaactttacatacattaacttcatttaatcttcataacatttctatggatagatactattattagtcccaaatgaaggcatgygcaagaggaagttacttgatcaataataaatagctggtgtcagatatgggattaggacccaaaactctttacatgttgcacaggatcctcttcactatgttttcctgcagaggatgtttgtattaatccattctatgctgctaataaagacataccagagactggataatttataaaggaaagaggtttaattgactcacagtttcacatggctggggaggcctcacaatcatgatgggaggcgaaggaggagcaaaatagtctcatcttacatggyggcagacaagagagagcatgtgcaggagaactcccccccatccttttttttttttctttttttgagagggagttttgctctgtctcccaggctggagtgcagtggcatgatctcggctcactgcaacctctgtctcccaggttcaagtgattctcctgcctcagcctcccaagtagctgggactacaggcgcatgccaccatacccagctaattttttgtatttttagtagagatggtgtttcaccgtgttagccaggatagtctccatcttctgaccttgtgatctgcccatcttggcctcccaaagtgctgagattacaggcattagccaccgcgcctggcctgggaactcccctttttaaaaccatcagctctcatgagacttattcactatcacgagaacagcatgggaaagacccacccccatgattcaattacctcaccagtctctcccatgacacatgggaattatgggagctacaatttaagatgagatttaggtgcggacatagtcaaaccatatcaatgttttactgctttactttccttgttgaaggaaagaaaaagaagggaaagaaaaagaagaggaagaaaggaaagggcatgataatatttatttgtatttattttgttgactaattcttccaaccatttcttcattgcacttagattgatgggatacacaggccctgtgctaatagctattggcgatatagccacaaacacaacagatgtaatcactttccttttgagcttaccttctagggcaatgtttctcaaccagggatggtttactctctagaggatatttgctaatgtctgcaggcattttggctgtyggagtttggaggtttgctatgggcatcaagtgggcagaggccagagattctactaaaagtctgcaatgcagaggatggtctcccacaacaaataattctttgtcccaaaatgtcaatagtgctgtttgaataatgctgatctagtgaggatgtaggatgttgaatcgtgacaaatatccaacatagagattgaaaagacctgaacttggaccccagaatcactctaacatttatgaccttgggcagaactaacccaacagacatgcaatgggatagtgtgtagagacacaggtttcatgagatgggataaacactctcttctaatgcagtgtcttaggaagtaaggagacttgaactggtcatgccacagagtgcattcagaggggctgtgtcctgagtgagtcaccaggatcccaatatcatatttggagatggaagaagcagagctactcacttctaggggtgcagacccaaaactgaggatatctgccatggccagagaggaatggggcatgcaactggttcctaaatgttctaggccatgtaagacttctagattattgaataaactagtggacaagagaagcaacactcaacacagctgagactgaattttctaccgtcacaaaggagtatggcatggttgaaagaaataaagaagtgagatatatcttaccctcaagtattgtaatgtacccattatgaggagatatatatatctcccagcttctctggccagccacagaaattggtagttttctttctttcaaaagaaaacaattgcagttgaagtaatagctttccctgtttttatgaaagttgcatgatgaggagatgagacccatgggtatgataaactttccaatgcctaagcattctgttttggatgctaacctctagttaggaagtatatacggcttggcttataaactgtttccttcgtatattagatgttcccttctccaaggaccaggatgctgagaccagaggtttaagaatttgtctccaagactcctgagccccttattgctgtctgcctcaagcaatccaatagaaacagctggtttcctttgggtaactgagaagaatgctcaatgtcaaaatcattctccaagccttaaaatatccaacaagatttaaccggtaccttgaacagtggctggctcatactaagcactctataaatatttgttataagaatttatggcagaatctaatcacctttgaggtgctagcttggatatggaaaatttggctcacaactttccttgtaaaagcagccaattaaattcaatacagagttattaattatctacacttttctggaacaataaaaataacagccccaaccttttgttcttggtgattagatgttgtatgagcagggttggcagtagttagggttgccaaagcctggaactataatttttttggaactccaattcagtgggccaatgccccctaaggcatcaatatctttattttacaaatacttgttagattcagacatgtatcacaccttggctgcaagtaatgggaccatgtcatagggattgaaagtgatccatccatggtggcgggygcctgtaatcccagctactgaggaggctgaggcaggagaatggcatgaacccgggaggcggagcttgcagtgagctgagattgcaccactgcactccagcctgggtgacagagcaagactccatctcaaaaaataaaaataaaaaaataaaaaataaagtgatccatccagccctgaaggagtttataaccaaagaaacagtaattgtaaaacaatgtcataagtgctgcagtacagtcaccataagaggctatgattgggacacaaagagatagagaatcttatatttccattgcttgagtatttttaatgtccgaaaactcattgtcatagaaggaactacagagaaagaaagtgcactaatgtttactatgcattgagcatattttaaataagtacttactatatgccaagtactatgggaggttctgaagaggcagagaataaaagagacaaccattaaacacacaaatacacaaataaacatgtaattccaaagagctatgagtgcaatgaaagaaaagtcaattgcctatgagacactctatattagtttccacttcctggttttagttaatcccatcaatcctgaaataagtattttaatctgtattttgctaaggagtttactgaggcttccagctgtaaagtgttttgccaaaagccacccggctggtaagttttggagctgggattagaagccagaattgtccaacgccaagcccatgcacttcactccaagtcctcataagggagcctcatgagatatgagccaccacattcagagacagtttcactaatttattagaagcatgcttattaaaacscattctttctattcagcctgttatttactttatactcctttaacatctaccacccatataggggttaattatatactatctcatgttgatttataaatgtggattagtcttgtttaagtaaggacatggaaagtctgattctcccactcaaatccacccaccttctgtctaggctgatgctggatgtagaagttcctattaaatactccctggtttaaagcacagatcttgaaatttttatggtattggatacagactccagagtaatggactaagagaaccaaatggctctgagttcccttaaaatcatgcagagctgtgttcaaatcccatctcagtccttactagctatatgcttctaggcaagactttcacacctctgggcctcagagtccttacctatgacagggagatcagacgcctaccttcagtgttcttttgaggggycaatgagttaaagcgcttagcaccatgcctaggacacagaaagcactaagtagatggtacttattatcacttctaggttttcctctttattggaaggctctcacctgaaccatcaaagctagctgctcaacttttaattcatttctaaaactacataaggagttggaaacttactgtattctakttttttctggawttttttcccttgcttttaatagaaagggagtctgatttgttccactttttcggtgccagtggttctcrttctcracggggggcaattttgtcccccattgtttggaaatgactggagacattttgggctgtcacaactaggctgggtggagatgctattgacaactagtgaatggaggtcagggatgctgctgtacctcctacaatgcacagggcagttccccccacacttctcaacaaagaattatccagctgaaaaatgtcaatagtgctgagattgagaaaccctggtttatagcggctagcagaccggagcccgggtgagctccaagatgatgtcatgctgggggagacccacgctggcctgcggtgagacacattacacatgggggatcgcaccatttccttgcagacccctcacctcaccaccgccgccgcctcatatcctgctcaggtccctcctgggaacccagggaaacctcgcagcagatggggtttcgtttagtcacattctctgcagccagattggattacatcgccagcagctctggctctgagagaccaaagttgcttgatgagctctgggctggcctttcaccttccaggacccaagctcaccccaacacacaggaggagaggggcttgtttgtggttctatctctcaaaaggacaaaagctgagaaacagaaaaagccaaaaggatattggtatcttctgttgaaaatggtgcctggatatttctgtctttatttcttgtgtttattatgacaggtgataaatattccgtagtctttttgaagaaatatataaattatagagatctccagggcgtctgtatttcatacgtgtctttgttataggctgttagaacaccacagactgggtggcttataaacaatataaatgttatttcttatagttctggaggctgggaagttcaggatcaaggtaccagcaaattcagtgtttggtgaggacctgcttcctggttcatagacagccatattcttgctgtgtcctcacttgacagaagggacaagaaagctctctgagccctttttcatgagggcattaattccttcatgagggcactgccctcaccaccttcctgccggtggttccacctctaactaccatcacattggggattatatttcaacataattttagggggatacaaatattcagcctatagcaatgtaaaagagtcaaaatggctattaayttttgagcagttataataacataagtactgtgttatgtgtttaacaagtattgcctcatgtaattctaaaacgatgatgtgtagattagcttctccacttgaaagcagatgtaatggaagatcagcaaagctggctcacttcagggccacagctactaagtggaaaagccaggattcctactcctctctcacttcctgcaagacctaagtcttaaccactaagccagatgcttcttactaaatggtttagtttggttcgagtgagaagatagctaatgttttgcagaaagcatgactaatccaagatcttccagcaactgaggagtgatggaagcatttctgattcctcttgttgttgctctttagcaaatgggtgaaacaggtaaaatragttaccaaagcctctcatctctcacctgggcatgaattctatgcctttccaatatacacatgctgcctcctgcctcaaattccaggtgttcccttttactagatactacgctaggaaccagggacctaaacattcagtacctgctcttcaagaagcttacagtcaagtgtgaaaacaagacaaggaacaatgttattacaatgcagcagaataaatcctgtgactgaggtaggtacatgctagatgtaggttgtctaacccaggctatagggaggattagctgatttatctctgagttttgaaacatcctcaaagcaaagtagtttgggaaggrtaatctggtagaatatacagcatatgcaaaagcaaagaggcatagaagagacttcaggagcagtgagtagtttgggagagatgggcacatgatccataggggagagatcatgatgagtactgtgtgctaagcagtgtgcatttattcggtttttctgacctcccaaaaataacaatgtccacttaggaatagagattttcacaatatacaagggaactgcccacagctaacccttatgagaacttgctggtcttccatagggatttcggcaccaccagccaccccagtgtgcttggcactaggttagggacttctagtcaagtgatccttgaggccgtagtccacatacaacatctgctacacattctagtctctcatggctatgatgcatgccggagtgggcactgattctctacctacttaggtacgattctgttttgccaaggattctcctayacaatgatgtccttcctccctccatgctcagggaactagatagctgtttcctttcttcagagaggaagatagactcactgtatagttactatgaagagatttagcaccttcccgccaccagcatctatggaagatacaggggatgaggattctttgggaactagaatctaaacttctcgtttgtaagctatttttggataggaagcagagccacatggaaaagatttgataatgttaacaaatgacacaataatgactagcgaagccaggaagtgtttctttttatgctcaaatgatgcacttcagttacatagacttctgagaagatagccttcccattctatctaaaatgccattacatcttctaatatgcaacaaaatgccacctgatccataaatcatycctccatatttagcccagaataccgctttatattttagttttatctctattccttgattaccctactttgccaggatcctaagtaattgctttcttatgttcccctctcatgagattataaaataaggagagcaacatttattatgaacctctatgtggcaggcactgggataattgttttataaattcttgttcatggaatcttcccaaattgactatgggcagatgttaccagccccatattaaaaataaaactgggtgtgatggcatgttcctgtactcctgtgactcagaaggctgaggtgggaggatcgcatgagcccaggagttcaagtctagcctgggcaacatagcaagaccctgtctctgaaaaaaaaaataacaaaaatgagtaaaatggaggttctgagattttaaactcctggagggcttaaaatttatgcctttatytagctctgtatgctccaccaacgtgacataacagttctctgaatatggtaagaacaaagtgagttttattgaaattcttggactatttcttttccctactgaagtaaggcaatctccatccaaggttcatcttatattaaaaaaaaatatgctaggaaatctcaacagtgttgtatcmaaggagtcagagcattaaatattttgggctcctgccacaggcatttactgtgaagtaaaggacatgtattgttctgtgcttcatcgtgatagaaagaacgccagcgacgtcatgaaatattttaggatcagatttgcaacactgtgcttccaaacagctgtgtgtcacaatgaggggcagggcctgggcatctgggccaccggtgttcggctccttctcttcttctctcttgacctttagcagactccgtgtctctttcctttgatggaacagctaatgaaacacatcctttccttgagtcaatccctgatttcagaaaaatyttyagacatyktgtgtgtgtgtgtgtgtgtgtgtrtgtakgtgtgtgtgtgtgtgtgtgtgtatgttggggggatggagggaagagtgaggaaatagtttccattcagtagtctggagcctgatctattggaaaatccccaccccccaaaaggaaatgctacaagagctcttctttcacagagtttggagtggattcttttctgttgtgaagtgcagatgtgaaaaattcacctgttctcacctatggtcagacagactgttcagacttttaaaactgtggcaggagcatttgctagccctagttgccaatgagctggatatgtgggtttcccccactaaacggaacttggtcttatggcaattataaagccacattgaccatacttgaaagagagaggctgggggtggccctaaygagttaatggcaatgttcaagttcacttaacttttgtaatcatccagtttgcaaatgcatagcatctactaggagaatgtataatattcattaggagttaaagatgataatgagaatatttattcatttgtttaacacctatttgcctgtctcttgctatgcattgagtattgtgctgggaagtgaggaatttagatgaaccagggggtttgtccttaaggggctcatagcttagaacaggagacagacaagcaaagtgacaatggtaacccattgtgatcaatgtcattaaagggaaagtacaggatttaggaactaatagtggctcagggtgtggggaaggaaggcttgctagagaggattacacttgaacagaatcttgaatatgatttagagcttggraggaaaagggaagaaaggaggcagtgggagagaggcagagatgtctayccataccagagtgtgaagaggagaaacagcatgctgcatttggggaaagtccatggagtgagggtcaggaatggagggagggtttggatgagacagatgaaattggcagaatctcatgtaggaccttgagagccctgggaaggattttgaactcttcttttctagaaaagttataggaggccatttttggatgtcaacaaggaggaataaagatagatttgtgcttgaaaaatatcatcttggctataattgtgaagcagaattgcaagcagattggagttggagagaccagcaaggggctgctgtagtcatttaagcaagaaaggatggtggctcaaaccagggtgggagttgcagggatggagggaattgggcagagtctagtgatattaaagacaaacttgcaagggtttggtgattgatgggatatgggtaaagagtagagagaagtaatatcctgaaatggaattggcaggtagggagaagagggagaagtgactgttgtttgggcctggtagttccagcttaggaatagaggcaatcgaaacaaaaaaattctgttgtagacctggcctcagcaggaaaccgtgcctgtgctytccttatctccagacttggcctgccagcacatacatatatcaccctctcacttaagatggagctaacagcaggcaaagttcatctcttagaggcccttaccctattggtttggcatgtctttattctcacagtccacagcagtaaaataataatattgcttacagagggatggcaccatggttaagtgcatgtaagtcagactgctggatttgtaaataggctcattcttaattagctatgtgagcttggacaagttactgaagccatctgtgattcagtgtccactttgataaagtaggggccatagctcttatttgacaaatttgtttaagagaaaaaaaaaagcagaattatatgtacatgagtaggcacctgataaatactgataaaacaaatgaatagttcttaccttattcttggttcattttctcttctcagtatataatactggatgcactttgtcttggggattcagagccctgctttctttaagggagaaagggaagttgaaaggtcrattaaagttttttggagaatctgtatcctgtgctgcattaggcatttttctcatgtcctctaacctcggattatcattctaaagtctttatctcatcatgttccttcctgttgcccaaaggatcaagttcaattttcaaatgttgagtaaggctttctagagtctgaatgtttgtgtcctctccaagttcatgttgaaaccaaatcctcaatgtgatggtatttggaggtggggcctttgaaaggtgattaagtcatgaggtggagtcctcatgaatgggactaatgccttcataaaagagaccccagatagccgcctttcttcttccactatataagggcacagcaagaagacaccaggaaggggccctcactagacactgaatctactgctgccttaatcttggacttcccagcctctagaactgtgagcaatacatttctgttgtttataagccacccactgtatggtattccgttacagccacctgaaaagactaagacaactttcatggccctttgtgacctatccccaacttgcttctttagccttatctcctgcctccacctgctaggtgctgactctaccctctgctttagatatgatatattttctatttatcaaaatgtcatgaccacatatggccccatgctaaaatgtgtgctgtaccttctgctgggactgtcctcagttcttactccttaattaaggctttgctcaaatattaccacctcttatagaattgatcattctatcctctgatccctggaaccttgagttttttctaatatagagcttattgcagagcatctcaattatttgttgagttcatctttcccttagtaaactgtgactcttcaagggaaaaacctgtaccttcttggccttggtagcccccaatcctaacccagaacgtggcgcagagtaagtgtttaggaaaactttactgaatgaatcagtggataagcmgattcaagttaaaactgaarcaacagtaggtagatgacataccttttttcctcccaccaccttcttgctttgccttgccttcaccccagctcagcaatctgctcagaaaagagagcatcagaactgaccaaaaaaggaatgaatatcctaagaaatkatgcagctacatattgcttkgcttgtgtttcctagataaggcattgattcctaggcactagaattatatactataattaaagagatttttttttaaatctatcaacaaagacctagagtttgaaaatctttcagttttctaatccaaattagggaaccagttacacagggtagcataggtcaaagggtagggctataagacctggattggctggctgaggataaataaggaagtgtagacttagtccaattgcagcccaaacttgacgtgtaacatttatacttagaaaatgtgtcattctcacgtcctttatacagatttgtccatcagtacattggattttcttaaacaactaccatttgattcccctattataattattgaagtgaattcactctgataaaatacagtccttagtagttcgctttaatgctctctaaaatattcttggaaaaatatgaacgtttttaagttgacaagtgcttttattataaaagtttaaatagttgtgagggatataatgtaaagtatattgaatatatagtcatttaaaataaaactaactattataaatagatttaatggattgaaattccactttaatttgataccaccattcatccatttaaaaatatacaagtagaatcttccctaacagttgaaaacttacatagttcttttgttttccttaaatgtttatttccatttcatttgctctatagaaatgtttcctaatgtagtatatttttttatactggaaattctttcactgatcatgttgttatattattctgaaacaaaacatgtatataaattcatattaaaatttctttaatgttctgtaaatataagatgctaacaaaaccsaatttcttctggattaaattatcataacaattattagatgtatacaactgatcaatctaccatacacttattaaaattttgctaaatgtgatgtgaaacataaggttttattagaaatgcttctctgaatgaggtgaactttttaaaaaattaggccatatgtctgctgaggaatattcattattgctaacgtgagatggtatttcataaattttatttacttttcattttttggttgtaagcactgagaaacctattcacaaaaataagtagatgggaaaagaaaaacttttcttatagcagtgttataacttcttaccaggttgtatgccaaaaatcacataaagatcaatcatcaaataggatttttaatactttctcaggtgacattttaattaggttccccttcagttttgttgtaactaaagcattgaaagtcatctgacttgcagaatgatttgctgcaaggtcattagtcattcactttctcaacactttttctcgaaagaattttgagttgtacctttgtttggtcccccagaaatttttataccccaaagcaactcgagatgagtgagaggtatgaattccatttgtaaagtgagagaaaagcatttacgaaaaagggactctcttcagattcctgagaaagagtgcaaatgaaagctgagaatctgaaaatttccttatctctgccaactagagcccatggaaaatctttgagtaactctgggggtactatgcatcacagtctgaaaattattatatgggatgtactttctatacttaaattaaatttccccatggaggcagcattgttatacaggtgacaatgagataacaatgcaaagaaaccagaagtcaagttcatatcgacttatatagctctgtctccataagtcagaaacaggaaaaattaacttgttcttcagcaatctaggttgacttcatgaacgagctggcgttcaaatgaatccttgaattgtggaaacagaatgttaaatctggaatgaacttcagatatcatctagtatggagaggacaattaaatgttgacttttacatcaatttggattaaatatttgtgattgcttacaattctgtgtcaagaagtagtcagaggaatcatctgagatctgtaggaaagcatgttgtgattgattagctatgcctgtcagaggaagcagggagagaggggcacaggtgatctgctcttgcccccctaggtacatagtccttatcacatgaaccacagggaaaactgaggctgactgagagcaggaagcttgaccaaaactccacagtgaattattgccaggatgggtagaattacatatgttttattcaacatttggtggtcattgtaaatttggtaacayttgcaactggaaaatttggggatgttttagagctggaagggagcaaattcttaattgagcaatacacgctgtcctttctttcaggctccttcacatttgatctctgtgcaatttgataagaggaggraatgggccgtcaattatgaagagactgaaaacctgaaaatactgagtatggtcttagttccctctccaaagggagctcaggaaaaatgccaagccatacaagccactgattactcatctagctattgtttctacctcaccctggcccaggaagacagatctactgaggaaaggtaatagaggctggcaaggttcctacttttacatctatctgtaatatccactcattcttagcatcttgcacatccacagggccrtacaggagtcttcttgccttgtattattgaatcttgggataggggtaggaacagacagaggtattagcagagatccaacaggatgtaaaacatacatgttgatgcaggggttaactttatgtataataaatagatttttaccatgcataccaaactgaatattccttcctcctttttctctcagacctctttctatgtgtggctcattcttttactctacaacataatgttcagttgattctggactttttctgtgacaaacaatgctgtaataaacatcctccttgtgcattcatctgggtgcacttctgagaatttatctgaaggataaattcctagaagtagactgtctgtaacatagggtctatgcactttcaatttccatagattctgccaaatggttttcttaagaggttataccaatttacactctcagctatggtatatggtaacccctgctttcccacaacctgccaacactgggtatttacaaacataaataaatggagggtttgaataattgtagttttgaattagacttggggcgtccctctcatctgccccaacttgtgtctccccaaagcaacctaactaggggatggctaatgccatagactctgaggcttactcagagcagaggctgaatgctcctgcttcagtgggaacagggggtgtttcttcagtctgtgccctacttggcatctgtccctgacagacccagccagtgtggggagccagcctctctaaccataagaaagaatggattggaaacaaattgatcttttcacagctggctgttcccctctttcccctcaacttggactcagctcagaacaaggttgccgatgttctgctgcaacaaagatggcattattgaggactgcctctttggggggaaatgtccttctccaagaatcgcctctgtagtttcaactatgacaagcctggagaccgagcatagctgtgcatctccaagggtctccaaagcgacacccaactctatccgtcctgttgatgaccatgtactcttctattggtgtccacaactttatttaaatgatgtcagatgactcaattcaacagaatctaaccctttattcatcctccctggagacctgtggtcagtgggcaggagagtttgggattcaaaaagaggagaactgtgtgaacacagggaaaaaggatctagtgtttatttctagcaacaccattactattgctgtccatcctattattctgcattcttttgcttcatagcatttttttaactgaaagaaatggctccacgaaggcagaaatattgtttagtttaaaactgcatcatcagttcctagaatacctccttatacattggaggtgcttgatacctatttattgaatggatgaatgaatttcatgagcacctgtgttggacaatttaaygtacatgatgatatttaatattttaactctgtggggtatatatattatctttatttatagctaacgaaattgggtctcagagattaagtaatgcttccagaaccacacaactggtaattggtaaaactgagatttcatttagacctgactgatcccaaacctatcttttagaacactgggattccagtttatctaagcttaagctcaaaagtattaaaatattttgcaatcaatgagggaagttgtcatcaaggacatttccaggtgagcatggtgtgttcaacaggaagagaaactcctccatactcccaccaaagtgagcaagtaccaaaatgttaagtgttaattaaatcttattcatctggggacaagcagtagggtgaatttatatgcatgtagcaccgattttgagctaagtaacaaggggattctgaaagacccttatgcggacaatgagtgaatgtaggcaagggcactaatatttaacaaagttatgctgtgtgctaggaaccatgctttaaatttatgattccacttaatcattataataatttcctttctttcctcttttattgtcttgcccttcccttcccttcccccttctctccccttcccttcctctttccctcccctttcattccctttgtccttcccttcccccttcccttctcttcccttcctgtcccccttctcttctcttctcttccctctttctccttctcaccctcccctcccctcccctccctttccctctccttccctccctttccctccctttcccttccctcccctcccctccccttcccttttctacccttcccctctcttctcttcccttcccttcccttcctctcccttcccccttcccttcccttcccttccaccttctcctctctcctctcctctcctcccctccccttcccttctccccttcccttcccttctcccctccactcccctccccttctcctttcccttcccttttcccctcccttctcccctcccctccccttctccttttcctccccttccctccccttctcttcccttccctttcctctacccccttccccctttcccttcacttmcccttatttcttttctttctttttctttgtttctccctccctctctcctcttttttcttttctcctttctttccttcctttctcctttttttcccttctttctttttaaattcccagacaagaattttgaagttcagctaaggtaagccacgcatagtgacggaaccagcattcagatttacatctcttgctacccatcatgtcacatagtgttaggcagagactggggtctcagttgcctaagtaaagtcataggcatgaagggtgctgcaggaatgactgagtggcaggctcctgacagcctggttgatagaccccaaggactacttgggttttggcgccatgcctagtatgactttatcctttaactgtttctcttgtcagtcagccccctgagggagccctgtctcctccttgaaactgtactataatgagaggtctccacaagggttccagaaagccacacagtgtgctgtggttttcccgagaactggctccaaggtagtgctctgagatcagtccttccagctcccatctcaaagatcttcaaactccaggctctcaagggttttgagctgccagttatgatgaaatattagcacagaagaaaataatttttttttctattctgtgtttcttaccaggacaccatggtttcagaatgatttatatactttgaatattttcaaaaaatttctttcaatgttgttccttctttaggtatttctcttatcacttgggctcagcttgatgcttctctggaatttttctttttttttttcctcccatttataaaataccaaacatgtgtccccagtctggatccatgtaactgaaaatcatggggaaattctttatgtaaaaagccctatagattgtttcggacaaaatcaaccccaaagagtttgtccccacaatatttgtgaataaaatcatccctctgaaataaaaacaccaccttaaataaaggagttcctctcaagcattttactctatatttattgtttgttcattcatgccatcatttgaaaaatactaattaagtatttaccctgtgttggtaattgtgctgggcacaaagaacataatagtaaatcacataaaatwccatcctcaaggatcccatgttctatcatactagagaactgwgtacagctgctcctcgacttatggtgggattacatcccaataaacccatcrtaagttaaacctatcataagtcaaaaatgcatttaatacacctaacccactgaacatcacagcacagacaatgtcaggcactttattacatgtagtaaagttgacatgactcttaatcctactaacaaccctaggagatagattctgttattattaccatttcatgatttaggaagctgagaatcagagaggttagtggctggggttgaaattcaagtagtacagtgtaagagcctttgcttctcctagaggctctgtaaaggtctgttgaataactgagtagacgatagattgattgcaatatagttcctctgttgcctttttgaagtgttagtttagtaagcaaccacagagaaattattatctactagagatgggaataggaacggtttcctaaatcagggttggccaatagtctttagttcaaactaaaagccatcacttctgcaacattatgtgtcaagcatgagctatatgacatgaaagataaagtgatgtagcaaatgtattcataattcagcaatatgagattatgagaaggagcatattcctgtgcactcactctgaggtcaaaggagacacccattttcctcttgagggaaatagtgagaggtgtttacctgaaggcccctggtttgtgctcccccatagctggggagagggagctgctgccgccctttccagtaggagttgtatattctataatgtccttatcacaattcctttaagggcctccagcactttggaagcatagaaaaaagaaacaacattcctgcatcgyggggccattgaygaataagaatgtttataagaaggcaagcatctttgcactctatacrtttccaaatcttttagaaacatatctaagaacttcttagttcccctccatggttactggatctacaaacttggaatttccccattggccctctgattgtatttggagtctgttcttcatcttgtggatcctctgggctctgtcttgaactgttggaacattttgctcccacagctrttggaagtgacccattaaggtagccagagtcagtcactcagcatcttaatggcaagaccaaaaggggtgaaagaaatagaagtcacggttagtaagcgactgacctcattctgcaggaattctttctggaaagagagcagtagaatgttgtgacaggcagtaagtcatctgtaagaatgtttaccgtggaattctagcaaaagaaatggctcaagaaacttcctgggtaacacaaatagagtctgctcagaggccccaaaagagagtgactggaaaactttagccttgtgagggaggctgtctactccagtgttggagtcagctggaggtgcagcagcgcttgagctatccaaactgctaggatgttgttaataaaagaaccttctcrttctcgagtcaacatggctaaaacagccagccatgagatgtatgggaaagaagtgcagagcaagttgttatttattgaatgtgtagttaggaattactatttccatttcatggaggcttaagtagattgagaaatttgtctgagttcacaaagtttgttaagtttcagactctgggtttagacccatgtgtttctgactccaaatcctgcatggttggcttttgtgagagcaaggttacacactgtacacattttttttcctccattgcaccattcactgtcctaggtatatagaatcctggaacacaggattggaaggacctttaggcatcccatggtctaatcttctcatggtacagatgagaatgggctcagagaagggaagggccttgctcagactcacacaaaggctagggccagaatagatggtgcctgactctcagttcaggrtgcttattctgacaaggcccgtcacttcacatggatatttaatgtattttgctagttggttaaaaataatgtaatgtatggcagaaccatctctctttcttcaaggtaagccattgctaagtctcgagtccttttttgtcccacagctccttttttcattgattattatcatttggtctataaagcctttcaccttcatttcagtgaacaatactgctgtgggagacactggagatgcaaagataaatcagtcctggttcatgagcttcaggaacttaggagcagtttggagagtcagatatgagaacagcttgttttcatacattattacacaatcatatgtaatatatagctggggggatatagaagtgaatatgagaagacctaccccaacctgggaaattagaggagtcttcctgtcttcctggaggattaattgattaaagtgactcattatttcattcctacaacaaatatttagcagacacctcttctgtgtcagatactcttccagttattaagggatgcagcactaagaaagcaaaaatattcctcaccttcatgggagaaatgcaacaagtgtaactaaacaaaatattactcaagtttgcagcagtgacaggcccataacaaggcaaaggtctacagactaatattgggttgaagatttatttttacaagggtggccagggaaggcctcttcaaggggaagtcttttgatcaaagaactaaagcaagtgacagggaagaaccttgcaaatatctgcttcccaggcagagtaaaaaccaggaccaatgtcttaagtcaggaaccagcttgatgtatttgaaaaagagcaaaagccaggcgtctgtagtcccagctacttgggaggctgtggcagaatggtgtgaaccccggaggcagagcttgcagtgagccgagatagcgccactgcactccagtccagcctgggtgacagagcgagactccatcaaaaaaagaaagaaacaaagaaagaaagaaagaaaaaaagaaacaaagaaagaaaaagagcaaaagccagtagggatggaggagagttattgaggttactgcaggaggagatggagatacagacatagacaatgaccagattgcagatgttgtgcaagtcacaggtgagtaggtcttgtcaataatttccctcctggtcagcattgctggcaatactatggcatcatgcatagagaaagaaaaagctaatagcaaatgaatcactctgatcatgcatcttgagatgttgccatggattacaattaatgcgttcctatccacaaggccagattccctcaaagcatctttttgggaaatgcagcgagctctcctggccccagcactcccacccaccccatcacacaccctacattcatcatctctttctctgtttctttgtcatgttgctaacatcccttgatggagatggtgcaactccaagtaaaactgtctccataaatatttagactgaatagaaaatgtgccaaagatgcaaataatctgtccagagggagaagagacctttctctttgttgttttcttcaggcttgtaatttaattcgtggatacatgtctttgaataatacataactatcaatttacctaaaagagtcccatagaaaccttagcctcttcatccttctgccatgcccctcatggcattttcttcttacgctggagtatacatttctctgyttttcttttatccctttctttcttctttattcccatgtttttgatcacatactgtgtgtcagcctctgttaagctcatctgtgcagagtctatactcactgcctgtcctcctctcatagtcacttgtcaattcattttcattagccttctccctccaccctcctttcctgagtctgttcccactgaggtcaacccagtgttcatattactgaacccagtggccatctttctgtttcttcttttaccagacctcttcactgaactagataatgttaattagtcctggctggagcgcaagtctcctttgacatctatttgcactgttcctctgcttgaaccactctgtctattccttctctgtcccttaaatttttggcttcttgtgggttgggtttttggtattcttctttgtctagcaccacccttgcttgccatcgtgccctcattcaggcctgggctttgacttgaatagcttctgaatctctatgctctgcctgtattggatagctggcaggctatgggcatgggctgctaggtcccagacaactcacactctcatctgataagtgggttttaatgtgacccttgttgtacctccttatttctatttcagtctcacttactgcttcctctttatctgttttcaagtcttcctactagatatttccttaagaaggcagagaaaccgtgctctcttagtaattgcacaattgaaattattcctcttgaatatttgatgatgacatattttgacttgatatagctttttcaatcttacaggaattctaaagctggaggaatgtttaaactccttccagctgccagtttcacgtaaagaactcttttctaaacctggggatatgagggactcttacattctcctttaatcaaatcaatttaggctgaaaagaaggccaagttgacagccagcatttcactgctggctgtgtatccatatacgtatgtatggatgcttagaaaagtggaatgctagtgatatatatatatatgcatatatmtatacatatatctatatatatagacatatttctgctttactaggtgagaagagttgcttgattttaagggctctcaatcaacaggcaccaaatgaacttacagcttgcaaaaatataaagcgctcaaggccgtacagacaaaggtaagggggcacagacctttcagttgtctacaggtattatcatctgaaattgacatacgaagaaagaaggtcagagaagaaatgtgacatgcccaaggcaatccaactgaaaaaatagccaatgtggacaataatcccagtttatagcttctagtgcaatgacttttgccagcacccagcatatcagaagataaacccactgactttctttagtgaagattgcraattgtttaaatcagagcatgtgtgcaaagtccagggtactatctaattcaacacttctgtaatttgaaagctaataattataagaattattgtccttgtccaactgttccttatactatttcattgttggttaatacattgaaaattacgaaaccttatttttgattggaagagtggtataacttctcttaggaattatactactagtatcctagtgaattatgaattcctacacttaaggaagcacaattataatagcattgtttttctttacttttgccaataaatcagtaagtactgcatgactacattctgctaaaacttaatagttgatgtggaagggaacttactccttattccatatagagacactgtagagtccctggaaatgctggctctcctccctcttctcatctgcccccagcaggggagaaatgagtttatgtattcaattgatgagttttggagctgctgaatatacttagctcaatgttcttattgtggtctccggactagcagcattaatagcgtgaagcaacgtgttagaaatgcagattctcaggccccactccaggctcctgaaccagaaactctggagatgggcccagccatctgtgtgttaacaagcccaccatatggtcctgatgaccatttgagtttgagaaccactagttagctggttccttcatcctctgtggacctgcctgctcacagagaggctgtgtctgttttctgccttgtggttaaaaaaagggtctgcctgttggagttggggaaggacatgcagctatgcagtgctgtccttgaataggtgttcctgtatgctaatttcaggtgcactgttggaaagcccatgatttcagatacctaaaccatgttctccaaccaaaccttatctaatgaagatgacattttaattcccttgtttaaatatgactctaatttcaaagtaggaagttggttctgactttgtgggtgrgaagaggatatggtgtctaaacatgkgccccttaaaaccaccataatagccaattacttattctttatggccatatgtcaggtatattttaaagttggaaggagctttggagtggtctagctgactttatagctgctggcaactgaagtccagaaatgggaaggcattttctcaaagtcactcagaaagtaactggagatagcaggctcccagtcctgggctcagacccacacatccagccaacataaccatggtgcactttaaccaattccaagttgaaacagaggaaatgcatatttggagcaatttatctcatcacattaaagatttcctaatttacatttctgcccggtaatcatggatgcctctgtatctaccccatggtcccctggtgaatatggcctctctcaatgtcaggtccttgtattcctgccctagcttcttgcatccaccttccttgacaggaactgaaaatgaattgcagctgttcatcatctctatggaggggaccaatttcttactcctaaactgagctcatcccagggaaaacacatagggcaatgaggaattcctcttaactatgacactaaactaccccttgtttttttttagtcgtttatattttcagtctacagtctaattatttctccaaattgggttacttgatcacctgccaaagacagtttctattcattaacaaatcttggccttcagaattatattttcaccaatctaattttcattggcattatgcttttctgttttctgactcctcttatcggttgtctacttgtatgcatttttcatgttcaaaagtttcatagcagctcctcctcactttgatgctagggaccaaccaatttatctctacttttatggcttgatattgccagctaatctttattgtgtaattactatagccagaaaaaatgttaagtgttttatatgttagcttaactgattctcactgcaatctatgaagcaggtactgttataatttctattttttagatgaacaactgagacacagygaagctatgtaacctttctaagattacccaactagtaagtggtggagtcaacatctgagctttggttatctgagcccataaattgcccgttagccctgcgttatactatgatcatgcacaggggtctggaaaatgccttgatgttatactttccttcttcttttttttttttttttttttttttttttttgacagagtctcgcactgtcacctgggctggagtgcagtgacgcgatcttggctcactataacctccgcctcctgggttcacgtgattttcctgcctcagcctcccaagtagctgggattacaggcacctgccaccaaacctggctgattttttttttatttttagtagagacagggtttcactatgttggccagactggtctcgaactcctgacctcgtgatccgcccacctcagcctcccaaagtgctgggattacaggcatgagccaccgtgcccggtctatactttccctcttgaaacaccattcctttctttgttcaggatctactgtggcaagcatttgagctcaggtcatgggtctccaaagccattttacacaatgataygtgtgatggttttctgggatggcccagctagcaggtgggkgagggatcactgaggtaggggacagtgtaattgacaggcttcatagaagctaagcaagggacacatttagttcaagttcagtggcaaggggaaaaaaactaatgattgggagatgcttaggtgttttctagtagtgtacaacaactaaaacttatccccatagacaactcttgggtctgaagatacccagcaatacagagtatgtggtagaccctggagatcctgctgctcaccctgtgttccagattggccccaggtcataggaaggtccctggaagtccacagaaaggattctcaagttctggtagggggaaatttcaaatgtatgcaacccatagaaaatggattctttggggacacctacagaaatcaaagatctaggcagaatttgttcctaggatctaagaattgtagggttaataaaactagctgtttatagaaaatttatgtaacttgttttactgatccaggcagaatggatccagagtttgtgttctggcatacagactaaactttaggagggatataatgactgagttgaatcttgaaatgttagtaggaggtagacaatgcaggaagatggtaaaggttgatgttccaaaaatgaacaacttatttcctggtatcagttaggatgtgtttggttgccactgacagaaaaatctgactagcaatgggtaaaacaactctgagtttattttttcacttattaagaaatctggccctaacaatatcaactaatatcaaagttggtatctgtatttgatttgatttttcatgagcatctcatttggcagtcacagttttggacatttcactcaaatcaggaggaagggggatgagtggcattacctacacgcaatcctctttatcagaaaaggaaaagtttttttcaaaatacccagaaaatttccacttgttcaggctcaaataatgtagccatttctggttgcttttccagattctaaggactgtgtgttaagttaggttagccaactgacagtcttccatcacccctgccatcccggaagatttatgaattcagagttggtgtttgctctttgtttatttcttcttagtagagagcacagtgtcatgcccaaagaagggataacacaaaacattcattgcaagaataaataaattcagttaatctcaaaaggcatttattatgcagtgtgacctgcatgccaggaactgtataggtacagatcaaggaacatagagcccagggactggtgaacagatactcaacatatacatgttccaatatgccatggtacatgttaggacatagaaacacataggggcttttcaagggaacccagagtgggaacacacggcccatgttagagggctgaagaaggaggacaaaaagggagtcagtcaggatagtttcaattatgcttaggtaacaaatgatccctaaaccttaatgtgcagctacaactttcaactccctactgtgctatgtggccatgttgcttagctgtggctctgttccacttcagtctctgcctagggcccaagctgactgagcagcctctatctggaactctgtcagatggaccagagaatatagcaaccacacattggctcttagaagcatcttcctagaagtgacacacatcacttctgcttatgcttccttggccaaaacaagtcttgtgamtctaccagaattgaacaggatgaaggtatataatcctccatgtgaggggcacaggatagaggcacaggataggtgagcagtaatatcatctcctacaaacagcaaggacagggcctaactggcggtgctctctgctccttctggtttacctccccgtctttctcctttcactagtgaccagctgtcaacctcacttagtgtgggagagctgtgagctgggctgagtcgccggggatgagttggaggagccaggagactgacttcatctccacctggtccaggaagggagactgagggaaggggcctggatccagagctggaaagatcttggcaggatgtggctttttaggaggtagaaagatggatttcaccatctgtctctttcctaatgtttggaggggtgttctcccgggatatagaggctggtggcccagatttctgagacatctttgtcagccagcactggctcagcacatatcaattgtgaagatcaactcctggcaagtgtggagtttggcatctacaggggccagtaggggagtgaaccagggatagggacaatgaccagaatccttacttgttgtcagtggaaataaacacgcataaatttgtctttagcacacgaagacccaggataagacccgttcgacctgcctatatggagccttgggtgagagatcatcttagatttttctgccaccttaaggtatttcaaactcccttatcttaaccctgcctgccagctgtgtttgtggaccctgcattcaaatcctcctttaaaatgctatttggaaaataagctttaagatcaactgtttttaagatacaaactcaggcttctgtctgtaggcaccaaaaatcatgccctggacttctagcatcaaggtagttagaatacctgttaagaatacatggaattggccaggcacagtggctcatgcctgtaatcccaccactttgggaggccaaggcgggcagatcacaaggtcaggagtttgagaccagcctggccagtatggtgaaaccccgtctctactaaatacacaaaaattagccgggtgtgatgttgggcacctgtagtcccagctacttgggaggctgaggcaggagaattgcttcaacccgggaagcagaggttgcaatgagctgagattgcgccactgtgctccagcctagaggacagggtgagattccttctcaaaaaaaaaaaaaaaaaaaaaacatgaaatttagttttatttctggctctgaagctttcttggaccatcaggcactcattaacttctctgagtctcatttttcccatctgttgaatggagatgctgatcatagctctcctgcttaccttaaaggactactgggggaattcagtgagagcctttacttactgaacatctactgtaaagtagacattggctttaaracaagtgggaacacattgtcatttataagatttatgtaaagtaaataaaagaaatttttattgttgtagttattctattggagaaaattaaagttgggtayacaatcacggactgyacctgattaattcttgcatctgattcttatgcctctgtcttcagaatatttgtaataatctacaattgtccattttggactgtgaatcttttgaagttgaaattaccttttcttaggttggcagtgtttctcacctggattatggcagtatcctcttatcttgcctctctgccctcagtctcagctgctccaatccattctatgcatagcagacaactataaagatatttcacttctgctgaaaatccttccattgctttatgctcttctgagacatctacttttttagactctctttagagaatctttaaatcctagcctctgatagtttctccaggcatatctctcaacacatctcttcctaccccactaatacagtcatgtgcattcccacagagaagcccaaaatcaatattggagtctctctgaaatacctgaatccttaatgaggtcccagcaccttggacctttgcatagttttggctagaacatctttgttcctgtgacttcccacttaggttcaacyccaaaatatctctcagatttcaacttgaaagtcccttcacttcctctggggaatcttgcatgatattcctttttttyctttttccttcctagctcattatcaaacctgacatctagtaattgtagttgctattaggcagtgtctgtttcatttttaggtggttactagactttgagctctttgaagacagggattgagtctcactcatattctcttttcttgaattctttcctttcttccataaatagtacgtgattttccactttgggccaggcacagtattcttaacgtgctcatatcttcatgcctaatatggtgccyggtacaaagcaagcaataaacatgaatgatggaatgagtcaaccagtgaatcaaaggtttagttcaaacaagttaagccctccctatggtctaggagcttcgagaggatcaacaccttttctaacttttgctttttaccatattctagttccttttttgtttcaccctctgacagagagaagctgagtgggaacaggctgccacatttttgtaggatatatcatccaactggtgaatcacccaggcccttgatttggcttactatttaacttttttttttttcttttttttttttagatgggctgtcactctgtcaacctaggctagagtgcagtggtgcaactttggcctgctgcagcttcaacctcatgtgctcaagcaatcctgctacctcagcctccagagtatgggactacaggtacagtccagcatggcaggataatttttatatattttgtagagacggggtctgtctttgttttccaggctggtctcgaattactgggttcaagcaatcctccggcctcagcctccaaaagtgctgggattataggcatgaaccaccatgctcggcctatttgaccattttaatgttcttattaacttgctctcctgggtggtaggaagatcatggcatggagtccaaggttctctcacttgcaagtgtcctttgtgcacttcgctgagtgtccttgtcctcatctgtaaaaaggagatggtgatatttagtcttgtgagaaactacttgagagaagtattataagtacctggttacttgatgtagtccttggcaaagggtggattctccaaaattatatcttcctatttctttcattcaacacccactcagccaggataagaccataccagagcaaggagggggactataaataacagcaaaaggacaatatctgcagagaaagtagggagctggaacactgactaaaggaaagttttcatattaccctgtgaattgttggacaaatcattcattgttttttgtttgtctgtttgttttttgagacagagcctcactctgtcatccaggctggagtgtgcagtggcacaacttcggctcactgcaacctctgcctcccaggttcaagtgattctcctgcctcagcctcccaagtagctgggattacaggcatgcgccaccacgctcggctaatttttttttaattttttttttttgagacggagtcttgctctgtcgcccagcctggagtgcagtggtgtgatctcagctcattgcaacctctgcctccctggttgaagcgattttcctgcctcagcctcctgagtaaactgggattacaggcatgttcyaccacacccagctaatttttgtatttttagtggagacggggtttcaccatgttggccaggctggtcttgaactcctgacctcaaatgatccacccacctcagctgcccaaagtgctgggattataggcgtgagccactgcgcctggcctggctcattgtttttatatataaaacttacatattttctttyctatgggagtgttgtgattactaaatgagagaatgaatgcgtagtcattcttcaagggattgtcacacagggaagcttcaatatgtttgggtaacagtaatattatatgatccattttcatttctatcaatttggtcagctaaactgtactttaattctgagattctttaactccgacagctggtccagactggcataggtcctgggggcaatgacagagtccagatgtccccatgggcatgacttgcaaattatgtactttgacagaatatggtgaggacaagaaccagaccrtgcagcactattytcacgccagctgcagagtctaaatgtgtttcctgacacctcagaaccttcttgggggagggcattctgggctgggtgatgggacatgctgggattttgttgctctccttcycttgtgggtcttaatggaaaagctaagtcaccagcaacagagaaatagcggtgtcaggcattgttgaaactttccatgtattctcatgacacatcatttccagttataaaaargagtggaggtgttgggctctgttgcctaatcrtggtaagaagtcccttttactagaatgcattttttcatcacagcatcatggtcaatgatcaaccatgtgaacttgtgtaagttgcataaacttttcagtatcttgacgtctctgtgggaaaagatggaggccatatgtgggagaacaaaatcatgattagagacatgggagagaatagggcttcagagtgcagctccacttcagaccagtgcatggcatagtacacattgcctgaactctctgagactcagttttctctcctgctaaatggaagtgatagttggtccattttatggagccgatgtaaggactaaaagttataatgcatataatgtcctttgtctggcacacattaaaggatcaacccacttctgctaccattattattaggaacaaatacttactaagaacctaccatattcaatatcacctgagtgcattttcatattcaattctcacaatgacacaaggagatattatcctaatgttgactgtgaaaaaaattagacctggagggttcaagtcacttgcccagattcacatgggtgtgagtggcagagttggaacttaaaccaagaatttttgataccaaaacctattgatgatctttccactgaaagatactgactagatgtcaccttgctttccctgtcaaatgctaatcagagatcaatgactaatcaaatggaactaattaattctgagtcaacaaatatttatagagcccctggtatttgccgagtgccatggagatgagagctaccatggacaaaaggatggtcacccaatcctcggtggtacaggactwctgtaaatgccccaggaggtcttccctttttcccaggttgatgccttctgaatcacttctgtccattcactgctttgtcagcagcagtttacttgactgttaccttgggtaattccttgagcttatttatttactatttttgagatggagtctgrctctgttgcccaggctggggtgcaatggtgcaatcttggttcactgcaacctccacctcccgggttcaagcgattcttctgcctcagcctcctgagtatctgggattacaggcatttgccaccatgcccagctaatttttgtatttttagtagagatgaggtttcaccatgttggccaggctggtctcaaattcctgacctcaagtgatccacccacctcagccttccaaagtggtggcattacagatgtgaaccaccatgcctggcctccttgagcttcttgagagcaggcactggatctttcttctttgctactttctctgcaacacactgcctggtacatactaaatgccaaaatcttattgacaggcttgcagcgaggaatgagcatctaccttgctggttagattgcttttatccagagtggtgatccctggggagatgttttgcacttggcctcrtggcagatgggtaacaagtgctggatcccagaggaatgatgcattcaacaagtcctgagttttatctatagtgccatgcagtgagttcctcctgctcctactgccatgggccttgggatgcaccttgagcactgaccccaccttgtcatgcttcctatgtgataagtttccttctgcagccagatagctctttgactcaatattacatcagtattataaactgagtaattgtgttttccttcctccaatcaacatgttgaagtcctccttcccaatgtgatggtattaggaggtggggcctttgaaaggtaattaggattaaatgaggtaatcagggtgaaacccttatgaatagaattagtgtccttataagagtcatgagaaagcttgttttcacttctgccatgtgaggacacagagagaagatgatcctctgtgaaccaggaagagagggccttcatgaaattctagatcttggagtttttgatcttagacttctctgaccccagactataagaaataagtattttttgtttaagccaccagtttatggtatttttgttatagcagcccaaatggactaagacactcagaaaccttcctgtggcctcctggaagacctttactatcctgcaatttctccagggctgtcagaaatttagacttcagtgtggttccagaactagtgtgcagaaatataaggcaaagctcataaccatcctccagtgttcaggctcagcataagycctctaggaaaacctttgtacctttctttgggcctcccccaccatagccctcatcatgctatgattaattgctcaattatctttctctctacattgtcggttatttttagctttaattagtttgccagataaatgtatcagctacaagcccttagaggacttagaagtctggaaactttggagaaactgtttataggactggcagtttctgatggagaacataggaagtagaaagaaaatatctgggtagtctttggatattccccagtgagggtctctgagactgatatgattgagcagctttatgaataagacccaagaggaaaggctggagaaaatgagtaaaacaaagggaaattttacgtacrtttttttgcccatgagctagtcatgaaagggagaatcaaatgtgatctcatcaaagatgttcccccttgagatcataactatatatakatatatatatattttttgagacagcctctctgtcacccaggttggagtgcagtggcatgatstcggctccctgcaacctttgcctcctgggttcaagcgattcttgtgctttagcactgagtagctgggattacaggtatgagccaccacacccagcccataatcatatattcttaagtgggtgtgtgtgcataggtatgtgtgcatgtgttttgcttttcaacctaaaagcgatcatacaatatgtcaacagccttgtgtgttaagcacaacagagttcctctcattcgtaaatgaagagtctgaggcttgagacttggtttgcccaagtccagtagcattaatacaggcagccaggtcttcagatagctgcccaattcccttttcrcatctcaaatatgtgaggtcttcagacaccttggagataatatttgctctcacctctttcctcaaagaattaaatgtgacttgccatcttgagttttgttacaaaagattgtaatgctattcaatagtggtatcatatgttatttaccatggaamaagatggcaaaaactccccctgaggaactgcactaaaagtaaaagatcaagaccaagggaagagaaaatacaaatattcgaaccctatgtatctaacatgattaatatatccgagatacatatgcggctctggttaccagaagccaaagaagaaaagggaagaagattcatttatttgtccttaggaaaatagcagttccccagtcaaagaaatattttgcaagcacttagatctcagagaggtcatttaaaaggcctttagcatttattcaacaaatacttatttactagctactatgtaccaggcaccatgctaagatatgaatatacataatgaagaaacaatgtccttgtttctgtgaagccaagtctagtgagggagaaagatgttaaaattatactcttctatatattatgatatggtcagtgatatcttttggctctgcgtccccacccaaatcccaccttgaattgaaataatccccacatgtcaagggcaaggccagctggaagcaattggatcttggggcagtttcccttatgctgttcttgtgataatgagtgagtgtcacaagatctgatggtttcataagtgtctggcatttcccctgcttgcactcattttctttcctgctggcctgtgaagcagtgccttccaccataattgtaagtttcctgagacctccccagacatgtggaactgtgagtcaattaaacctcttttctttataaattacccagtytccrgtatttcttcatagcactgtgagaacagactaatacagtcagtaatggaaaagagtaagatgatgggagagaatttgaaaggatttggtttagctagaagatagctcttgttaaagtgatactatagctgagattgaaagctaactaggttttaaaaatttggagcattaagaagaatagtgttcagcaagaacagcagatgtgaaggtcccaagtcaagtacaagactgatgtattccagaaacttttaaggacagtgtgttagtgtgaatttcagaggccaaggaggagaatagtctgggatgagccctgagagtagcaggagcccagtccccttccctgcagagcyttgctaatgttggtgagatgtggtctggagagagacattaaaactactgaaggatttcaagagagaaagtggctgtcagatttgcatttaagactattgctctggctrttggaaatgatagcaagaaaagtgggtgaaaacaagagtgcaagtctggaaactagaaggaggttatggaagaggcacctttgccagagattagggtgatctggaaatacgatagaaaatagacattctaggacgggcacagtggctcacgcctgtaatcccagcactttgggagaccgaggtgggtggatcacgaggtcaggagatcgagatcatcctggctaacacggtgaaaccccgtctctactaaaaataccaaaattagccgggcgtggtggcgggcgcctgtagtcccagccacttgggaggctgaggcaggagaatggcaggtgaacccaggaggcagagcttgcagtgagccgagatcgcaccactgcattccagcctgggtgcagagcaagactccatctctaaaaaaaaaaaaaaagaaaaaagaaaagaaaatagacattctagagttaaaaactcaacaagcttgatgcaaccatcttgtttcaggggaaggcaattactgcacagagaataatcatggacaatgcccctcaaacctccacatccccaaaatcaggacatatagaaggttggagcaaaaatataaccttggctaaaataattaatartgttcttcttgattcaatttgcaggagacattcagagaaaatatccacactcaaaactgaaatatgagtgccacacagtcaytgcagctcacatctgggaattttcaccaagcaactgaaaaaaaggctattttcagttctttcatatgctctttttgtcataagttgggttcggggggtggggttcagaacccacagttgctgtggtgagagaarcaaatttgacagcttctggcagagcaaagcacaagtatttcctgcagagtttttcaaagtaaatgggtctccctccctgggcagatactggcaatccttgatgactcacttctgaggggcttagcccatcaaggattcaaagagagggagaggcctggcaccaggcccagtgctggtgacaaagtggcttcttgcctgcttttttgtagttgctccagtgggcacatctgtgcccggaatttgtcatgagacaatgagggtttgttcyctgtatccgaaatgatgacttcatgattcttttatggcagagtaagagttggagcagaggagatagaggattaatggagttaaaggagcatatyacaaagattgagtttcatattggttaagatctggaatgctttctatctggcaaactgtaaaatccaaagcattaattacattgacaataaggacccaagtgtcctcccatttagctgttttcaaaaggtattatgagtatccaagctgtcagggtgatgtgtgtagaytttttttcctttcctgtgtcaaaagcatgatgttgagcagtggcttttaacatttttgacaataacccatagtcagaagtaccttttttttttattgtgactctcaacacacacatgtagtggaaaaagtttaataaaaaataccactgcaataagtaacacacacagtttctatgatattttacttattaaattatttcctgtgtaaaaatgtgcctgtgacccagtagattgttttcatgactctctaacaggttgtgacctgcaattggaagacatagatattgaggaaagaacacaggtcttggctgttgaggctcatgacctacctccccagctgtaggagatttttctgtgctttagtatatgagtaagcatgagagaggtgatgcttcagtaatacacactcccaacatttcagtggcttaaaacaacaaaagtttatttcacactcatgctataatggaggcttgactccatatgatgcagagatccaggctgcaggagccttcacatcaaccctactttctcctcatctgctgcaagagcaattttacttctagctctgactcttttttttttttttgctgtatggagctgggcaagtcatagaaccagggctgactttatgtgcatgtgacttaggcagttgtatagggcctggtgctcagaagggccttgtggcttggcttactactctgctgtcactgccttgaaagtcttaataattttttaacaagaaggctctttttgcaccaggccacacaaattatgtaggtcatttgcatacaatcttttctaagtctccatttcctcatctgtaaaatgggttaatagagaagaactcatagcattcttaagaggactaaaagaaagagcatagtacatacacatgtagttttcaacttgctgcctttatcttcagtagtaccgctacagaaaacttttacttaatcaagttagacttctcaccttgaaaagctgtacttccttatgttgccctccctactcccttctgtttatytaaattttgttcattattcagggctctactctaacacctcctcagggtcctcttccatgactgtccaagctgttttcagaacccctaccccattaattgtggatcccttctttatgactcacttacttttgtttcctcttctcctttggacccttccttggttaggatccctcctacctcgcctggaacattaaacagcctccccattagtaacccttttagtagcccctctccagtttgccctccagttccactctccatcataccagggtcatcttcctgttaccccgaaatgtcttttctatcatgccatttcagttttcagagacttcagtggctcttctcacctaaagggcactgcccttagtcttgcatttaggatctggctctcaggccacattttgggtctcattttcctccactccactcacacactgctcctgcattcctgctctacaccatctctggaatagagcttattctcctgcctttggttctttgtacattctcttccttctactaagatggcctgccaccataggcgtggtggctcatgtctgtaatccaatcactttgggaggctgaggcaggtggatcacctgaggtcaggagttcgagaccagcctggccaatatggcgaaaccctgtctctactaaaaacacaaaaattagctcggtgtggtggctcgcgcctatagttccagctactcaggaggctgaggcaggagaatcacttggacctgggaggtggaggttgccgtgagccgagattatgccactgcactccagcccgggcaacagagggagactccatctcaaatataaataaataaataaaatggcctgccccaagatttaccccacacccctgaaataatccaatctaccttttactgcttggctgaaatcctatctcctcaaagacctcctgtgccagctcaggatgaaaagtctcccttattccttggaatccctatggcatttcttagaatctgacatatatcctgtatgtgtggggcaattcccccaacatcttggttgccttttctgctgggtctgtgttccagggaataaggacaaaaacaaaatatggctagagtttcagtcacacttcgtaggaactccctggaatgaagggttcctgcagagattgcctggggcccttcccgatcccctcagctgttctgaatcatcatcctcctctgggttctccaggaattttgtacattcttctaacatagcactgactactttccatttgagttatttcttgacatgactggatcccccacgaggcatatcttattcattattgcagttctaacagggactggtgtcaacagtgaatggatggattgattgaaggatagagactagagaggaaggaaagttgctggggaggagattccctgtatatgtaagtgtgagacaaggtgggctgtaataacaacctcttactggcacaaagcaacaaatatgtatttctcattcatattcatgtccactgtgagttggccaaaattctactccactgccttttttttttttttttttggagacagggtttgttcttttttatagcctggagcatagtgacatgatcacagctcactgcagccttgagctcccatactcaaacaatccacctcagcctcccaagtagttgggaccacaggcctgtaccaccatgcctggctacattttaagattgttttgtggagacagggtctctcactatgttgcttaggctggtctagaactcctgggctcaagtgatcctctcgcctcagcctcccaaagtattgggattacaggtgtgagccactgcgcctgtattccctcttcatcctacaaccaagcctgatggagaatccctaatctggggcatgccattcagtggcagaaggaaaggaaagatggcagagacacacaatggctctcagagcatctgtgaagaaatggctcatgtcatttcaactgacatcttgttgaccaaagcaagtcttgtggccacaggaaggataacactctcaaagggatgagcacaggagaaagaggcagtgagtattttgacaaggacacaatcttctacagtgggggcagagcttcatgtggaattccactcacataatgctctttgtctgtckgcatacccacactcgttctgaccagggaagaaggagggggccatctacttggtgattccaggagctggatgtgcagggcgttgcatctgtctctcctcttgctattgagcataagctgcctctagcgggcatgctttctaccttgccctctcagggattgagggatagactctctggatatatggttgtctacaacttggtaggtaggtctgtctaatcctggagctccatttattcatccgcagagccatatcctccaatttgagatctacaagtaacaacggtggttttgattcccgccattgcctttactcctctgccttaattttcaattggtttcaagcttggaaaagaaagagagttcaattttttgatctctctctcatatctccataacagactttgcagaaatatcaggtcaggtcctgttactgatgtgttcattctcatgggcaggaagagacacttcagtgttgctgctgccasgattgtttcacttaaaggaactctctagctgtcagagaaagagtgatactctgaaaatagtctctaacatgctgcttcctgctctaggatcatcttatagaaaagacactatgttcatcctgagccaacctggtccctttatagtcagatactagagaacaatgagaaatggacatgggggatatctttagcgaacatccttagtgaggatctgtctcttcttttcctgttgggcatgagctgcttctagagagcatgctttctacattgccacccaccccaccccaccctgagggatccaggaatagactctccaaatccagggatgtgtacaacttggtaggtaggttgggtagggagagtgttttgcacaagctagagctggggttcatatgtgtctggcaagtggagttaatggtactgttttctatcaagtgtccagttgcataagttgttatacaaagacggtgctttagcttttaactggaggaagagggggacatactgacatgtgggacagagggtagagaargaagaggtaaaattgagagggaataacgtgattaatttccactcagcctggcccgatgagagactgtgagggtgctatctaaagcttaaggaatcatgtttatgaaaaaactrtaagattttgggaagcagcagcgctctttggagattggcaacaaatatgacaatttactcaaaagatttttatttctggtggttctagactgagtgacagcattggacaaagatgtgtggagcaggatggtagctggaggagtgccagagagagacccgggatctcaccaaggttacagtgyctgtggctttgcgaagattcctcctaaaattctgctcatggaaggatttcaaagaaagactgagtgaacttgttcctgagaatgcttgaagggacrgggaaacattaaaaaataaagactgggttattggaaattgatggtggtgttggtgggggttgttaagaactaccgttatttacacactgatgaacttgtgacctcatctatattcacaggctgctggtctctgagctattgagtccacctacttatagggatgttctttatattggggtgaatgttttgcttgtgatatatcactctgtattagtttcctattgctgatttaacaaattagcacaaacttagtgacctcaaacacacacacacatacacacaaactcacacacacatttattatcttacaattctggcagtcagaagtcctaagtcagcctcacgggctaaaattaaggtgtcagcaagctatgttccttttggaggctctagaggagagtttttttgcttgtttgtttgtttgtttgttttacgttttctagattctgtgactgcctgctgtccttggctcatggccttttcctcattatcaaagacgacagtacagtatctttcagcctttctcctaactctgatcctcttgactccatttcataaaagccatttatctcaatatcttcatctcaatatccttaacttaatcacatctgcaaaggtttttttttttttttttttttttttttttttttaacatataaggtaacgtctcccggggagcattattcagcctgctatattctccaaatagttttcattggctttggtttcatcttatcaagaggagatcaattcaacctttactttgtacccattgagtgccttttgtctgctagaaatttttcaggctttatttcaatcaacccccactgtgattctgcgaagtaggtatttatgtgcattctatgaatgaggaaacagggttgcatgcaaattgatctggcttaaaaactcactctttctttacaactttaaatatttcatctccagaactactatattgtcatgattgaaatgactggatgagaaatactcagaaatttcaagtccctgctcccctggtggctacagaagtacagttgagaggcctttcagtatttcttaatagacagccaccttccctctgcctggagtagatgagattcctgactcctgtctttcttctgagactctgcccaggataccctagttttgcggaactgacacacccaaatgtcctgaatgagtcataaactcttcccgaagctaacatgtgatgaggagggaaggctctttctgccacagcctgtgaaatggtttccattacagtgtttctgctgagagcagcaattctgtctttatcctctttcccatgactacagagcctccaacatctgactgagttgacagaagagtgagggggacactggaraaagtcccaggctggaggccaggggacctggaggccgatattgtcattgcctctgactagtcctatgctcttgagcaagctgctccagtgtctgagtctctggtctcatttggactaaaagtcttggtccttctttgtgcttacaatttaaaggatccctgcatagccaaacggtaccattcttaatggcatgaacaatatcagaaagactttagataacattcatttggagataactttgccatgtgcttcactccctctcaaccggcaatatggcagagtggttaagagtgtagaatctgcattaaaattccagttctgccttttttgactggtttatcttgggcaagccgcttagcccctgtgtcttatattcttcatctatccaatggggataatgataaagatgatgttctcccccgagggttttgatgactgctagttagaccagcactgaccactgttcrgtccaatgaaagtacttgtctcatgccctgctattcattcttcctcaatctcccgtagagaaagagacttcagctttaaactcagagtctttataataggccatcagctgtgtgaccttaggcaactcaattcaactctctgatcttcaggatttttcaactttaaaataaggataacaataagagcaacttcatggtgaagggggataaggattaataaaacaacacatgtaatatttctaggagaatgcctggcatatggaaaatgtttgctccctttagatgttatcctcgtcttgtgtgaatcttaaaatttctagcctgcttcagatttaattccattttctttctaagatgtgagaaaacataatttgatatttcaggccaagttaagcttttttattgagctcacacagttgtaaatatgtacattaaagtatgtcctcatgaagaacaaagggcatggatttttccagcaccctccatcccccaactcacagcctcaacatccgcaaataattaatgcatagaggaagtttacggttggccacccaaatgcatctcaaacattaaatttaaaaaactaaaaggatgaacccagaraactgctataaacttcaaagaatctattaaggacttagacatatggtgttaaaagatatgtccaagatttatggcactgggcctacaaaaaagaattctggataggcttctgctatgtgaaatatcaggaaagggtcagcagaggtgagctctgtgtccccaactgcctggagtgacctcacgagcagaatcagatagcagtggacttagctcagttcttggctcctccagatgcaagccaaacttcaatgcttagggcagcgagaatgtactggacagagagccgctaaagataggagaagatagatcagatatgttttgcatttaggtcctttcttttttttttctacctggaacacaggcagtgataattatggccactaaccatattgagcaattgagcaattgcaatgtgttagatggttttacattgaatttaatttatacctcataacaaactgtaaagaatgtactaccgttttcttcttctagaggggaagaaactgaggctcaacaagtttaagaaagttkctgggagacatatagcacacaaacataaaaccagaatttgaatacacatctatttcatgatggactacttttgtggaactgttaaaggaaacaagtaatggccgaaatgaatggtttagtcattgatctgcttgaaggctgagcagcagatcaaatggcctcttggacacccaagattttgggagtctaagactctgcctttctgaattgcataccttatatgtctacatgagtccttccaaataagctgctcagcacccctggtccatagatcctttgtaattattgcctcctctcaaaagcacaacattgattttatccacctggaagttactgtctgcctgcttttagatagagagcaaatctcctctttgaacaaattcatacaaaactctcactatagtcgggacccaggatatgttttaaaattgattagaagtgttccttgagcttttatttcccttctgtttgtggaggaaggaacagaaatatttccaacttaccttatacaataatgactgttacaggtatgacctcagacccagagtttggggatggaattttctgcctttgatcttggtttgtactgtctctaagatgtgacatctcttctacactgttgccacccagcatccatctgtcatattccaaactgccaatgtgtgtcacccaaaacattagatgacctagttrttctccctgcctagagccttgcctcctctaattcacttcatttaaaaagaaagacatttatcttataaaagaatacaagcatacggaaaagtacctaataatatagtaaataactgtattgcctactgttagcaacttttaaattacatatagatgcatcaataaaggcaatatatagtattgttgtaaacacatttaaacctggtttaaattttatcacattacacaaaccattaagtgagtttctttttaaaaactcaacatcatgttttaagaattagctctgttaatatatgtagatagtttattcatttttaactgctctatggagtacctttgtgtgaatattccacaattgaattaatccactctcttactggtatgcattatttgttgttataaacaacactgcaataagcatccttgtacacatttctttgtgcatatttgcacaagtaactgtggagtacatacctagatatagaatttccagacacataatattgtcatatttatatttactaaagaatatcaaatttactttctcaacagcgttgaatgagtttccattgccctacattcttaccaataattggtattgtcagatatttgacaatcttatgggtttgacaaagggtttcgtttcctaactttgtgtttgttagtgaggaaaattaattcacatttatttattagattttaattcaaatttattagtgagaataattatcttttgtatgcatattggctactgggattttctctctcgtgatttgcctgtttgtgtcattgtgattttttttgtcttgaatttttaatatttaatctgttgatttgtagaaatttttatccctgcatggtatgtgtactaattttgacacaaaacttgcaaataacttcttcaagtctgtggtttattgtttacatctttttggagatatatttatcatttacaagatttttagytttaccatagtcaaatttataaaattttgaatgtttttatggtttgagctttsatgtctgactcaataaatccttgcttctgacagtcaagaagttatttttcatttatttatcatttatttcatctatttatcattttataagttttaaagttttactttttgtattgtgatcctcagtgtatctggaatttattttgatctaaggcagtcttctaattttgttttgtttccatatggaaacccaattgcctttgtaccaattattgaatagtctaacatttctctatttttttatagcagcatctctgataatgccaattttttcattcatgtccctgtgaagagaccaccaaacaggctttgtgtgagcaataaagctgtttatttcacctgggtgcaggtggcctgagtctgaaaagagagtcagtgaagggaaataagggtggggccgttttataggatttgggtagataaaggaaaattacagtcaaaggggggttgttctctggtgggcagagtgggggtcacaaggtgctcagtaggggagcttttgagccaggatgagccaggagaaggaatttcacaagacaatgtcatcagttaaggcaggaacaggccattttcacttcttttgtggtagaatgtcatcagttaaggcaggaaccagccatctggatgtgtacatgaaggtcacaggggatatgatggcttagcttgggctcagaggcctgacattcctgtcttcttatattaataagacaaataaaatgaaatagtggtaaagtgttgagatggtgaaaatttttgggggtggtatggagagataatgggcgatgtttctcagggctgcttcgagcgggattaggggcggcgcgggaacctagagtgggagagattcagctgaaggaagattttgtggtaaggggtgatattgtggggttgttagaagaaacatttgtcctgtagaattattggtgatggcctggatatggttttgtatgaattgaaaaactaaatggaataagagaaggagaaaaacaggtataaaaggtctaagaattgggaggacctaggacatctgattagagagtgcttaaggagattcagcatagtcctgccagcaaagattatttatttacttcaagagtttagagtggcagtttggggatagcactaggagatatcagctgtgatggcttggagaaacagtgtaaactggcagtgtaaacaagagcagggcatgtatgagtagttgagaacagtgaataggaatgactagacagaagatagtagggatgacaagttttttggggcacagtccaagttggtctggtgtctggaatgagactggggcctaataaaaatgagcgtctatacaggagctyaaatgggmtgtaccytgtagcattctgaggacaggcctgaattctgagaagggaaagtggtaaaagtattatctagtcctttttaagttggtggctgagcttggtgaggtgtgttttaaaagactattagtccgttctacttttcctgaagactgaggactgtaagggatataaaggtttcactggatattaagagcctgaaaaaatgcttggctgatttgactaacaaaggccagtcttctatcggactgtgtagaagtgggaaggccaaactgaggaattatgtctgacagcagggaagaaatgaccgtggtggccttcttacaccttgtgggaaaggcctctacctatctagtgaaagtgtgtacctagaccaagaggtattttagtttcctgactcagggcatgttgagtaaagtcaatttgctagtcctgggcaggggcaaacccttgagtttgatgtgtagggaagggagggggcctgaataatccttgagaagtagtagaatagcagatggagcactgagaagttatttctttgaggatagatttccacgatggaaaggaaatcagaggttctaagaggcgggctagtggcttgtactatagcatagcctgcctttgctggtgtgtggtgattaggcctggtggaactgccatcaataaactaagtgtgatcagggtgaggcacaggaaagaaggaaatatggggaaatggggtgaatgtcaggtggatcagagggatacagtcatgggggtcaggtgtggtatcaggtataatgtgggaggccagattgaagtccgggccaggaacaatgataattgtgggacttaacaaagagtgagtacagctgaaggatccggggagcagaaagtatatgtatcagctatgaggaagaaaatagattttggaagttatgagaaatgtagagagtgagttgagcatagtttgtgattttgagggcctctaaaagtattagggcagcagcagccgctgcacggagacatgatggctaggctaaaacagtaaggtcaagttgtttggacagaaaggctacagggtgcggtcctggctcttgtgtaagaattctgaccgcactaaccatgcctaggaaggaaaggagttgttgttttataagggattgaggtttgggagattaattggcacaatcagcagggagagcacgtgtgtttttatgagaattatgccgagataggtaacagatgaggatgaaatttgggcttgactgaagtaatgggggctgtctgtgaagccttgtggcagtacagcctaggtaatttgctgagcctaatgggtgtcagggtcagcctaagtgaaagcaaagagaggctgggatgaagggtgcaaaggaatagtaaagaaagcatgtttgagatctagaacagaataatgggttgtagagggaggtattgaggataagagagtatatgggtttggcaccatggggtggataggcaaaacaatttggttgataaggcacagattctgaactaacctgtaagccttgtctggttttaggacaggtaaaatgggggaatggcaagaagagtttataggctttaaaaggccatgctgtaacaggtaagtgataacaggctttaatcttttcaaagcatgctgtgggatgggatattgggattgagcggggtaagagtgattaggttttaatgggatggtaaggggtgcatgatcggtcactaaggagggagtagaggtgtcttatacttgtgggttaaggtggggagatataaggggaggatgtgaaggaggctttgaactgggagaaaaggcagcaatgaggtgtggctgtagcctaggaatagtcagggaagcagataatttagttaaagtgtctcggcctaataagggaactgggcaggtggggataactaaaaaggagtgcttaaaagagtattgtctaagttggcactagatttggggagttttaagaggtttagaagcctggctgtcaatacgcacaacagttatggaagcaagggaaacaggcctttgaaaataaggtaatgtggagtgagtagcttccgtattgattaagaaggggacggacttaccttctactgtgagagttacttagagcatctgtgatggtcctgtaggcttctgaggcgatcaggcagtgtcagtcttcagctgctaagctgagaagatctgggaaggagtcagtcagagagccttgggccacagttccaggggctctggaagtggctgccaggtgagttgaacagtctaattttcagtggggtcctgcacagatgggacatggcttaggaggaatcttgggctgtgggccttccttggcctagtggctagatttccggcacttgtagcaagctcctgggggaggaggttctggaggaacccctggcagctgtggttcaggtatttggagttcttgttgtgctggagatgtggctggggtttgtctcaccgtggaggcaaataattgcaacttagaaatacgttgctacttggctgcctctactctattattgtacaccttgaaggtgaggttaattaagtcctgttgtggggtttgagggccagaatttaatttttggagttttatttaatgtcgggagcagattgggtaataaaatgtatattgagaataagacggccttttgaccttttagggtctagggctgtaaagcgtctcagggttgctgccgaataagccatgaactgggctgggtttttcatatttgatgaaacagcctaaatgctcactgatttgggagaggtctgataaagaaaaaggagcattaactttgactatgcctttagctttagccacctttttaagaggaaattgctgggcaggtaggggagggctactcacggaattaaactgtaaactggaccgggtgtgaggagaggaggtgataaaaagattacagggtggaggagtggaggctggggaagaattgggacctagcttggcctggcgaggagcagcctggggaggaggggagaggtcagatgggtctgtagaaaaggaagattagaaagactcagcgacgcttggggttgggacagaggggacaggcrggagggaaagaaggaagatttgggatgagttgcactgggcacagagactaggaagggactgatgtgtaaaagaatgcctggacgtcaggcacctcagaccgtttgcctattttaccacaagaattctttagatcttgcaggatggaaaaattgaaagtgccgttttctggctatttggaactactgtgagtttgtattggggtcaagcagcattgcagaagaaaataagacgcttagattttaggtcaggtgagagctgaataggttttaagttcttaagaacacaggctaagggagaaggaggaggaatggagggtggaagtttgcctatagtgaaggaggcaagcctagaaaaaagagagagtagagacacagagggaaggggtttgggagttcttaccttccagaaaagcagaaaaggggtcaaggcacagaaataaggggttggggcacggagataagaggtcggggtgtggaaataagggatgrgggcacagagataagaggtcgggstacttgcccctcctttagaaaagcgggacttgccgctaagggtgaaagagaaggggttgaggggttcttgcctctccttcagaaaagcagagaaggggtagagacayggagagaaggggttggggtacttgcccctccccaagaaaagcaggacttgctgctaagggtgaaggaccaaggcaggcatccttgcatggtatgacacctctgaaacatgagtgaataatcagaggtgtccctgcaatgattaaacaccaagggaaggctgccttcccagtctgtgacaggcgctggagttttgggtccacggataaaatgtctcctttgtctctaccagaaaatgaaaggaattgaaattaagagaagggagaggttgaagtgtggcgccaagattgaaaggagaacgaggttgagggatagtgagggaggttgaagaagagagtaaaaataggctgcttactggatttgaaattggtgagatgtttcttgggctggtcggtctgaggacctgaggtcataggtggacctttctcatggagcaaagagcaggaggacaggggattgatctcccaagggaggtaccctgatccgagtcatggcaccaaatttcacttgcatccatggaagagaccaccaaacaggctttgtgtgagcaataaagctgtttatttcacctgggtgcagctgggctgagtccraaaagagggtcagccaagggagataagggtggggacgttttataggatttgggtaaataaaggaaaattacagtcaaagcggggttgttctctggtggccagagtgggggtcacaagatactcagtaggggagctttccagccaggatgagccaggagaaggaatttcacaagacaatgtcatcagttaaggcaggaacaggccattttcacttcttttgtggtggaatgtcatcatttaaggcaggaaccaaccatctggatgtgtacatgaaagtcacagtggatatgatggcttagcttgggctcagaggcctgacaaattttccatggatttgtttcaaggtgcttgactgtattgtattgatctgtttgtctcttctttatataaataacattgtgttacatacagtgttagaataacgcttgtatgtggtcttgtatgctttattcccttccttcaaagctttatttctttattctttcttatgaagagtataaatactggctggtccattttaatgaaaaccttattataattaactaaaattgcaacaaatatgtagattattttggtggcagaacaggaacctctttaataataagtcttctgttccataaatgtttattcaggctttcttctatgtctttaaagagattcttaaaattttcttctaaaagtttatttatttttttgctagaattattcataggagcctgaagtttttcttgctattgtaaaagtatcttcaatttccattacactttataattggtatggctgaattctagaatgaaaataaatttgcgttgatctaataacttgctgaattctgttatcttttgtaatattttatccgtatttttttaagagtttctaatcatattgtttgcaagtgaatgtcattgtatctctttttatctatttaaaaaatattgtgtttatttttcttattgcattggccagggcttatgtacaattttgaatggtaggagtgatagcgggcatttttggctttttccagattttcaagggaatgtttctaatgttccatcattatagaggccacatagcacactggttaaaaatgcaagatcaaggaggtttgaatttaggctctgtcasttaaaagttgtgtgatttgggccagataacttaacccctctgtgttcrtgtttttccattagtgaaatgaaaataaacaaaagcaacaacaacaataatatttatatcagaagaatgttgtgaggattaaacatatatgtgtgtatatatacacatacatatattaatatatgtatgtatgtatgcatatatatttktgtacttagaacagtgcctagtacaaatttaatgctcaataagtatttaataatgataaaaagtgatatttactgaatactttttgtaaagattccttataygtttgaggaaatttcttcatattcctacttttcctaaagttgtctttatagttgagagttaaattgtatcaaatgcttcttcttcacctaataagataaatgatatgcttttttgttagtgttctaaaatggtggttaattttaacagattttctgccactgaactatatttgcattcttgggctatcattcattgttactgttgatgttattggtacactatatatttgaaattattattttgctttccatttataagtgagattgggcttttttttatttttgtactgcctttttacattttgaacaagaaaaggattgtttgtyctttggtgattagtaaaatgtgactgtatgaatttatctgggtattgtttctttttggtatgaaaactgcttatcaattaaaattatctgatatctaattttgtgtaggatttttgtttgtattgatgtcaatattgattgtttctatggtttccataaagtattttatttatgctacattttcaartttgcatatttggaaaagctatgaaatctacaaattgaaaaatctacaaaaaatagcatgaaagttggtttaatttataatgatttaaaaaattctctactatagccctaattgtggtcccactttgttactatagtttaatttgtgatctctttttttttttgkttttgtttaataatctcttttgcttctttgttttcttgtacattaatatcagttgtttacctgtttctgtcagaggcatttgaaccagaacgactccatcttgagtaggggctggtaaaataaggctgagatctgctgagctgcattcccagtaaattaggcattcaaagtcacaggatgtgttaggaagtctgcacaagatactggtcataaagaccttgctggtaaaacagtttgcagtaaagaagccggccaaaattaccaaaaccaagatggtgagagtgacctctggttgttgttatggctcattgtaagctaattgtaatgcactagcatgstagaaggcactctcaggagcagcatgacagttttcaaatgccatggcaatgtcaggaagctaccctataaggtctgaaaagggaaggagccctcagctcctagaattccccagctctttccaggaaaactcatgaataataacccttgttaagcatataatcaagaaataaccataaaaatgggcaaccagtggctgatgccactgctctgcctgtggagtaaccattcttttatttctttactttctcaatacatttgctttcactttatggacttaccttgaattctttcttgagcaagatccaggaaccctctttcggggtctggatcgggatccctttccagtaacatttcccattcttttaatttttattgttttattacctttactttcttgagttgaatgctgaacttattttcaatcttgctttttttwaaaaaaaaaactaataaatgttttttaaggaatacattttctcctgttgacaaaaagcatcaaactccgtaaaatatttgaagagatttattctgaaccaaatatgtgtgaccaatggccagtgatatagccctcaggagatcctgagaacatgtgcccaaaatgatgggctacagcttggttttatacattttagggtgacaggagacatcaattaatacatgtgaggtgtacgctggtttggtccagaaaggcccagacaaccggaagtggargcttccaagtcctaggcagattcaaagatattctgattggcaattgactgaaagggttattatcaataggaaggaaagtctgtgttgtggtaataaggggttgtggagaccaaggttttatcagacagatgaagcctccaggtagcagccttcagagagaatagattgtaaatgttgcttgtcagacttaaagagtctgctctatcagtaattccaaaagggaggagggtataatgaggcgtgtctggctcccctttcccattatgaattgaaactagtttttcaggctaactttagaatgtccttggcccagaagggtccatttagatggttggggaggtggggtgggccttagaattgtaaaccaaaaataaaattctaaggcccctcccaaccaactaaatggacttcctttttagtcagggttcttaaaatttaacctgaaagactggtttaggccatgaaaggaagtgggggtcagacatgcctcattaatacctctctggcattaacaacaacacagacttcaagtctgataagaaacattttacagcctgttctctctgaagcctgctagctaaaagcttcatctgcatgataaaattttggtctccacaacctcttattgcaacccaaacatttctttctattaatcccaggtcttaagacaaactcaaccaattgtcaactgtcagccagaaaatgtttaaatttacctatagcytggaacctacccccctccccaacagccccctgctttgagttraccaaaccaaatatttcttaaatgtgcttgattgatgtctcatgactccctaaaatgtataaaaccaagctgcaccccaaccaccttgggcacatgttgtcaggacttcctgaggctgtgtcacaggtgtgcattgcatccttaaccttggcaaaataaactttctaaataaactgggacctgtcttacatgttctgggtctagagatttttatttttggtttacactgggtctacagaattttatttttagtttacacttctaataaactttagaagtttttttggcaactcagaacttttgatatttaggagtttacttttacttttccaaatatatattttaaaatctatatcttttattgttgattttgcatttaactgtttgtagttcagaaggacgttggcataatttcctattgtaacgagtggcaataaaagcaacataaaggaattatgttctctaaatatatcatgtgatgtataataaatagtatattaaaaacccataattaaatccaatttctctggtcttctcatgtcacattagtcacgtttacaaaggcaaaatcttaaagtattagcatttgcttgccctttggtgttcttaaacagcagagcccccaaacaaaagcctatccagtgaagactcttattttgctaaacatccaagcacttcattttctgagtgagagatgatttatccgctccacaacatcagtcatttgaacctcagtgcacagtgtgtgaaccagtggcacttttaaagaataactttgaagaataacacacatgcaaaaaagtgcacagatatgtctatagctcaaagaattttctggaagtaagcacactatgtggcctgcttacaaatgaagaaacagaatataaacagccctctcatgcttcttccagtgataactccaccatcacctrgggtaacctctaccttgagttatagcaacacatatgcactcttcctgttattgaactagatgctcttttgtgtctgtcttctttggctcatcattatgtttatggaattcaccaatattattgcattgttatgtagtattgccttgtaagaatataccacaatttatccattctccctttggtggacagtggaccaggtttccagttttgggttattatggataatgctactacaaatattgttgttatatttttggatgaatatgtgtatgcgtttttggggggttgtatacatctataagtggaattgctgggtcatgggatatgcatatgtatgtttaattttagtagatatgtgyaaaaagtattccaaagtggttaaattgatacaatttattgaaagttctggttgttctgtgtctttgtcaacactttgtattttctgtcttcagttttattctgtacttyagtaggtatgcagtgatattgcattggtatttgatattggaagttayctaatgactgatgaggttgagcattctttcctgtgctattgatcatttgtgactcagtgttttgaagaaatttttagtcttttcttcatttttctattgtgggtgtcactgactcaggccagtgtgttggatggtaaaagaatgtaccaagacacttgtggggaaagaaaggcagatttattaaagaaaatacaaagatatattgcaaggtgcaatgggcagcacagcagagaaggggctgtctgcaaagatgyaggcactgcagggaagttttatagggccatagtggagggggctatgtgtggaacgagataattgggaagaggatgttgtgccaaggagttgtctgtgattagccatctctcagaaaaatgattctcccccaccctgggagccctttttcattgttgctgacttaccaggactccatattttctatgggtttatcatttcttcttgatgtgtataaatcttttacatatttttttgatacatatcttctgtcagatacaagtattgtaaatttttcatcctaaatctcgttttcagtttttaatttttttagtaaacagatgctcttaaacataatatagtctaatttatcatattattattattttatagctgttatttttaatgtcatctttaagatgtttttgcctactgcaggttactgaatatgttgtcttttgtcctacaaattttatcattttgcaggtacaaaatatgtttatcttaatctaactggaattgatacttgtgtatggtgtcttatggggtcaagatctattttttttctctgtattttattttacttttgccatgtggatatttagttgtcacagcaccatttattaataaggcattctttctttttctgcactatcatctcacctaattttaccaccaatctggtaaccactattctacttactattaggttggtgcaagtgtaattacttctaatggcaaaaacatacagtaggcaaaaatatcttaaagataacattaaaagtaacaactacaacaattataacattaaaagtaatgacaaaaactgcaattacatttgcaccaacctaatacctccatgagatcaattttttttagcttccatatgtgagtgagaacatgccatakttgtctttctgtgcctggcttacttattttacttaacataatatcctccagttccatccatgttgctgcaaatggcaggattttattctttttatggctgaataatattccattgcgcatatatatatatatatatatatatatatatcacattttctttatcccttcattctgtttctgtatgtattttttattttttaatttttgtgggtaaatagtaggtatatatatttatggggtgcttgaaacattttgatataggcatgaaatgtgaaataagcacagcatggagaatgaggtatctgtctcctcaaggatttatcctttgaattacaaacaaaccaattatactctttaagttatttaaaaatatatggttaagttattattgactatagttatcctattgtgttattaaaaaatgtcttatacattcttctattttatttttgcacacattaaccatccccacctcccccactgtayttcttaatgcttctttttattttttttttaaattttgagacagagtttccctcttgtcactcaggctggagtgcaatgrtgcgatctcagctcactgcagcttctgcttcctgggttcaagtgattcccctgcctccacctcctgagtggctgggattacaagtgcataccaccacgcccggctaatttttttttttaagtaaagatggggttttgccatgttggccaggctggtcttgaactccagacctcgggcaatccacctccttggcctcccacactgctgggattataggtgtgagccactgcgcctggccaatgtttcatttttaaaattatcttaattactatggctttagaatagattatgtaaatgctctttttcaaacagaaagtatccgtatgtatttcagaataagcggaagcattacatttgaatcacattttctttatgcaagtgagagaattattggaatgcttaggcagtgttataacctgggaacaagaaactagtttaaagtaatcaaattgtcagtgactaagaagtcaaaagtcagtgaaaaacatgcacatgcactaacgtgttagaagtgcccattttgaaaatcaaacgtgtgactgactattcgatcatcaatataagataatactcagttgacgttttaaatattttatctttgcttatggaattttttttactgaatttttaaaaactcagcctcatcgataactttcaataactatgtttgattcattacacttattgtgttttattgatgtatttggaaattctactttgggggctgtgtgtgtgttctccatcttacagattttagagagattgtcaaattttttcatatcccattgttccctaaaatgatttaaaagacctcaattgtagtttcatttgttttaggacacagtcttagattttaacatacatacttatctattatatttgttaataaagtcttaggttagtggatatttctatactctttctgaaaatgacatgcatcttacaaccagttggacttttaagayagtctaggccaggtgtcagttgtgatacagcagtcatatctcaagtaatgcccagtttttgagtgcttctttttttttttttttttttttgagatgaagtcttgttctgttgcccaggctggagtgcagtggcatgatctcggctcactgcaacctctgcctcccgggttcaagccgttcttttgcctcagcttcccaagtagctgggacttcaggcacctgccaccacgactggctaatttttttttttttttttgkatttttagtggagacgggggtttcaccatgttggccaggctggtatcgaacacttgaccttgtgatctgccagcctcaacctcccaaagtgctgggattacaggcgtgagccactgcacctggccttgagtgctccttatctccataatcatgtttctgctggttagaattttagaaaagtagtctttttgtcttttcggttgagtgatttatctaccaatttttatcattttatgtgctcattattgtattctacatctcagtcactacttttttattcttcagaatttctgaactctgctatgtgtctaaaatatgttttatgttttgtgtccttcaaagtgcatgtgttggaaacttaatccccaatgcaatcatactgggaggtggggctgatggcaggtgtttaggtcgtgaaggcaccactctcatgaatggattaatgctgattgctaaagagcttgargctacaagttcgatctcttgttctgtcttgcccttccacctttatcgtggaataatacagcaagaaggctcttgctaggtgctgacttttcaatcttggacttccaaacttccagaaccatgggccaataagtttatattcgttataaattactcaggctgtgggtgttctgttatagcagcacaaaatggacaaagacaatgtctaagtgtgggtttagttttcttttttctgatcactaattaatgttcattttctttttcttttttttttgttttgttcattcagagtcttgctctgttgcccaggctagagtgcagtggaaagctatctcagttcactgcaacctgcgcctcctggattcaagcgattcttgtatctcagactcccaagtatctgggattacaggtgtgtgccaccacacccagctaattttccctatttttagtagagacagagttttgccatgttgctcaggctggtcttgaactcctgagctcaggtgctccacctgcctcggcctcccaaaatactaggattacaggtgtgagccactgtacccagcccaatgttcattttcaatcaggtgaccgccattctactcactactttaatgagatcattttttttagctctcacatgtgagtgagaacatgtgatatttgtctttctgtgcctggattacttatttcacttaacataaagtcctccagttccatccatgttgctgcaaatggcaggattttattctttttatggctaaataatattccattgtgcatatataccacattttctttatccattcatccactgatggacacttaggttattttcatatcttggctattatggatagtgcttcaatgaacatgggagtacagatgtctctttgatatactgattttctttcttttcatatatacccagcagtggaattgttggattatgtggtagttctatttttaagtttttgaggaacctctaaactgtttttttttaccctaatttacatttccaccatcggcktttgagcattcctatttctctacatccttgccagcatctgttattttctgtctttttgatagtagccattttaactgaggtaagatgatctcattgtggttttgatttgcatttccctgatgattagtgatgttgagcattttttcatatagaggttggccatttgtatgttttcttttgagaaataactacagatcttttgcttatttataattggattataaagggtttgtttttgctattcaattatttgagtttctatattctggctattaatccatcagagagatagtttgcaaatattttctcccattccataggttgtctctttactttgttgattgttttctttgctgtgcagaagctttcacttgctacaatcgcatttgttaattttttcttttcaaacccacagctaatacaatactaaattaaaaagaaaaattgaaggcttttctcataagatctagaacaagaaaaggatgattatttttatcacttttatgcaacatagtactagaagtcccatctggagcaattagataagagaaataaataaaagctatccaatttgaaaaggaaaaaaggcaaattgcccttgtttgcagatgacattatctaatattcagaaaaacttaagactccaccaaagaactgttgtaactcaaaagcaaatttagtaaagttgcaggatagaaaatcaacatacaaaaatcagtagcagtagcatttctatataccaacagcaaacaatctgaaaaaaaaaaaaaaaatcaaggaagcaattttatacctaagtataaaaataaaatacgtaggaaaaaatatagctaaagaagtgaagatttctacaatgaaaactataaaacatttacaaaataaattgaagaggacacaaagaaaatggaaaagtatttcatgtttatgaataagaagaattaatattgttaaaatgttcacacttttaartgataaacagattcaatgcagcctctatcaaaatatcaatgacagaaatagaaaaaacaatcttaaatctcatttggagccagaagaccctggatagtcaatacaatcctgaatgacaagaacaaagctggaggcatcactgtacctgacttcaaaatatactgcaaaactatagtaatcaaaacagcatggtactggcataaaaacagataccaatggaacaaaatatagagatccctggaataaacccatgcatttacaggcaattcatttttgacaaaggagccacaaacatacactgggggaaaggacaacctcttcaataaagggtgataggaaaactgaatatccatatgcagacgaatgaaactagaattattgaaactctctcaccatataaaaatcaactcaaaaagaatgaaagacttaaatgtaagacctgaaactataaaatgactmgaagraaacactggagaaatactcgggacatttgtctgggcatakaattttttgagtaagacctcaaaagcacaggcaattattttactcattttggttcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattggrttttggttttgctgtttggatgttgggctttcattttcaggatagctctatcacatatttcrtaattttgttttgtagaattatcttawattgaaggaatgttgttttgtgctaatacattttctctttctttagagcatatgtgatgttttcgtccaatggcccctggatctgctatccacarttgtgttttatgtcaactgtttgagattccttctccatggacataatgaggctgttttgataccattactcaagggagcatatagcttggttcagcttgacttttgactgcaaggctgggtttgcatatactgccttttttgtcaggtggctgtagccctagacagcctcttattaacgggggatttccagtctcgcttattaacaggggatctcaatctccctcttaatcctcagcagggagcctgactgcagtctacagcttcagcttcatgttggctgaactttttctctgttcttcccatagaagtagaaaacctggatgcctcttcctgtgtggactaggagcccagaagcctgtagcttcagcccattttaccttttacttattctatttctcatccacagagatgttgcatatttgaagccagctatgcatttgaatgttctctttggaactgttatccgttatcattgtgagtttggagcaatgccacttgcctggatttcttcctttgtttcctacctggcaaacctaatggtattccctaaactccaaatatctgcacatcatttccctgtttataacatttcattctatcccaattgaacttcgaacaagtgtaaatgcattaccagacctttgaagacctttaatcacagggcctttgctcctatttatatgaagctgctttcagtttcccgaatgcattgcacttccttcaaccacaaggccttcacatgggctctttctccatctgataaactctcacttctctgtcttgtttgtacttagtcttcctgatctttctcatctccatttaatgtcacttccttcccttttcttcactccacggactttccttcctccactcccacttcccatgtgataacacttgtcccatttccttgtaaccactttttaatcactctttcctcatagactgaagctttttgtgaatagagaacatgtcttgctcattcaattcttaatcactgcacctagcatatcatagacacccagtaaatattacagaataaataaattaatgaagaggcaatttactccttcatcttagttcttccttgctgtccagacatagtcctgacttrcatgtgacatgggggaacaaactgttctatctgtaccaccagttaactaaggagtccttcaggctcagctatgaattccatcaggaaaattctgagctttttggagtaatggagggagaggtgatgggattctgttgtggaactgagagggtccagtggaagtgagtcagaatgttcagtgttctgcaacaaagacttcccttcactaccccttcaagcatcacacagactctccaggtctggggtggcttgtggtcccatgtggttattacatgcacctctacgtactgaatttgttgatccttgcagactagcagtgcaagagctgatctgaactcaggggccctggagaagcaaagtcactcctccccattctgaagcagctgtggttccttacatttggacacaggcytgagaccwtggctacagtgagctagtgctggggaatctacttattgatcaccggagcagctgctaagcctggctttcaagaacatccctcagagggtgctttcactgtgccaaaatctttcattcattttcctctaccattttaacatgcaatttagttaaaacactttcctttcatgtgtgtgccaagatggtgacttcataaaggtcaggaaatgaggaagcaagaacttccttgaaagatttaaaataaattatttttagtaataataaatgacaaattgggagatttaagacaaagattcctggtagttgaatgcgctgaaatctatgatgtttgrggattgttaacaatcttcttccaggatttgatcggttttgtacttgtattttctcaatctactattctttayttgctctccttcctttagaatggacaaatttttgtaaacttttaagttttctctttccttgaggtagtaaattggagttgagctacacaggttcctctttcctgatatcccctttctgctatttgatgtgagatggctcttgaggctaaaagtgcagtgagggaaagagagtcacattagcagagctatccagaatatcctctggttattttggagcctatttgtaaaataagcagggaagtgtttggggaagagtgttggcttaggtaggaaagaaaccctccttggtctttgccctgctgtttaccagccacgcggccttgggtaagtcattcaagaaatgtaagcctactaactgtcaaagcctcagttccttttacttgtaaatgagagagttgaattaagtcaaagtagtcagttcaacggcttgcaaagaataagggaatttaagaaagcagagaagtttcagggaccatggagaacaaatcgtgtgtagctaatatgtaactccagaggatggttactgtacaaaaaaagcagatcaggcattgtcagcacatctgattatttcaagggaaccccagatctggatttttatgtgaaatattctaatttcacatataattagcamctcattaagaaaaaaactaaaaatgtcctgyttagggcaaaggagacatatctgtgggctcatcactgcctgtggacaatctgtttgcaaccttgggaatagatgacctctgacaccagattaatcatctgccttcaaaattgactaacttcactggacccagtcccaggtggagagtctgaaagcctagaaattgctgcagcagcatcaacttcctgttggaagctggggaggcaaagtcttaccctgagaaagggctggatttctcttaaaattttgaaaggccaaaggtggtgtcagcatttttgtgatatggcaggaataatactgtgcagtggatagggagctctgaattcttaccttgggtgtgctaaaaacctagcctggacttggttacatcccctcctttctccrgtgttctcttggtgggtttataattttagattaaatcagtatttctcaaacttcaatgattggtgtattacagtgtggtagccagtctctgagatgatycttattccttgtttttgcttccttgtgaagttccctcccatatggaataggagtgatttatgcaactaattagagattgcagaagtgagtgtgtgacttctcaggatgtgtcataacagatattgccattttcaccttgatctctcagatcacttgctctggaagtacactagctgctatgtcatgaggacacttaagcaacactgtggagaggtccacatggtaaggaacagcyagcaccaactcacaggtgaatgaaccaccttggaagcagatcctccagccccagtcaagccttcagatgactgctgttgyagctcacattttgactgcaacctcatgagggactttgagccagaatcatccccaattcctaacctacaaaaactgagagataaaaacatttatcactgcttaggcaaccaagttttgcattattttattatgcagcaatagataactaatacaaaatcatgattattgctatattggcctaccattgataatgttacacattaatgcatgtcaatgcatttaaatggtttattctttcaatttaaatagatttattttaagaggaaaagttttatgttgtaaatraaaaataagcatcactagccacaaaataaaaataactcagaatttaatttccttttcctgtgactsattttttatttttatgttttaaaataaattttattgcatgtatttaaggtatacaacatggtgttatggaatacatatagatagcaaaaaggttactacagtaaggtaaattaacacatccatcatcttacacagttatcttttttttgtttttgtttttgtgtcaagagcagctaaaatctactcatttagcatgaattcccaatatagtacaattttattacctataggcccacgttgtacgttaaatctctaaagttatttatcctacatatttgttactttctctcctttgacctacattttcctacttcttccttttctatctcctcctttgccccagtaaccactgttttgttctctaactctgtatatttgattgtttttaaaagattccacatataaatgagatcatgcaataattttctttatttttctgtctatgtctggctyatttcactaagcttaatgtcctccagacacattcatgttgtggtaaatggtaagatcttgttctttattgggctgaataatattcccttgtatacatataccacatttttgtatccattcattcatcaayggacacttaggttgtttccatatcttggctattgtgaataatgctgcaatgaacatggaagtgcggatatctttatgaggtgttgatttcatttcctttgggtatatgcccaggagaaagattgcattgctgggtcatatggtagttctatttttaatccctttagaaatatccatactgtttttcataatggctatcccaatcttctccaatctaaattccatttagataatgttgcctgcagaagactctgagcctaaggcatctcatgtctttggaacaaaactgggactttatccttgaattaaacaaagtgactgayacgcaattgagcagggaataactttctcacagtgaaatttgatgttaaaatgccccctctctctacacccccaaactgtcttacagtcttccaaaaaatgttggtgttttcttttcccccttttgggaaaattagctaaagtttatgtgtttcttcacattccaaaacattctaagatagcacataatctctgtgtcaagtaagattgcctataataaagtcctgtaaaatagctcaccccagtttttttgaagtattgctactaatataacgccttgtggttatttaaagatgcacagtttccaaaaccctgctctgttcactgggctttagtagcaacaaagagactaggtctgcctgaggattatcatccttaaatgtatagattaggaagttgaagcctggagaagtgaaattagataagataataagataattcatctagtaattagtagggctggggttagaacctgggtcctctgggtcctccatcactctgtgtggcctgcacagaatccagtccatggactcttcacatgtgagkactctagctgcacatgtggggactcccaagcaggtatagtatatcagagcttgaaggaaggctggcatggcagggtctggggtggtttgggggcctgatgcacggttatcagaggagaatctttaaggaatctgagaagctgagaagatagcaatgtcaagctcgccaagcagctgccatggcaaatgagattacagaagcagtcttccctgcatcccagaggctgccacagctgagagtttaaatttgcagcttcagaaaggaaagcagacacacaaatgtgcacacgaacacacacacacacacacacacacacactcactctctctctctctctaatgcccatgtgatatcaaatgtagccttgacaatgctccagcccccacagagatgctagtctctcccacttctcagtcaactccctgaaccccatctccctacatggctgtaggatgtttttgaatttctactaaaaaatatttctgaatctttgtgcatcttgaatttgtccaggactaaagaaagaaaagtatattttgatgtacaggaatgcatggagctttgtggttctctrctcaagtggagtagtatttttatgtatattgggtgacaaaacattcagattacatggaaaccaaacatgtcaaagcattttggagaaataatttggtagctatttccagatgcaaaaatacttctgtttctcagtcaagttctttgtcctatttaaacacaggccactagagctagtaattgtcttttcttaggatattttaaaggtcctggaacacaagactggaaccctggaaggatcagattgtctcattttaccagaagagagactgaggcacaagaggagaccaagcatggctccagggacgctagtgagtcacctgcagatgagattattcaactgtataaatgaaatcatgtttcacctgcaacraaagaaagcacaaatcaccagtttttacttctttctcttcttttactagttttaaatggctaaatggatcacctcccttccattcccccactccatctcccttaaatttggaaaccaattacattccagggaggtagagatctggtgataaaggactcgtttcaggtttcacacttgaatacatttttacagcttgcttataaaattctgaaagctggtctcctagtagaagggmagatgctgtcaaatgctaaatggtgcagttagagggacattcagacctcctctctagcccttcctctttttctggcacccaaaggcacgggcctttcctgtcagctgtgcaggctcctcattactttctaggatcagcacatggatcggctctacggggtgtcagactcagtgagtcagcaaagcaaagcagctgggctgagacagtgagacagtggacagtcacccagaacagaggcagggctcatacaccagcagccggggaggagaagctgtgcagaatccacatcagagacatagacccaggggcatcattctaatagagggcttccacttttgatattcttctttgttgtctggtatgatgcttaataagtggaaggtttaaagggaaggtgtgggggtgagtctatttattccttgtaatatttttccgccaatttgaaatagacgaattagttcagactatgacattttggctgatgcaaccttattttattacttattttattatagatcagagtaaagggttaagtcatttaattcaggtcaaattctaaaagaaggatattactcaactcataaactatatagtctgcatcaagagaaatggcttttatcaacagcaatcaaactcccttatccaaaatagtaaaatcttgagacttccaattttaatgtaatattttccattttaaatatggataattatttgtgctaagtagctaaatataaccagagacattaatggacaaatgataacaacacaaataatatatttataacagttagcatttttaagtacatcatttaccatattatagccacactgcagagaaatttatttttaatggatgctacctttgtagctcccctaattctgaaaagattttgtttaatctttttagcaactctaattaattattatcatcttcatatacatttgttaattcaacagatattcaacagatatagctattatagtataagaaattaaaacaaagtgatgcgaaagaccaatctcaggggagtggagatctttggtcaggatatgaagggaagggctctctttctagatgatgggtttccaggtacaaagagatgtgaagatgtgaagattgttccagggcaagctccgaggtgggcaaagtgactggtgatggtggggagagggacaggagggaggttgatgaggttagcaggkgctaggttatgtaaagccatgtgggttgctgtggggaattgagatgagaaaacagagacattgaaaggcattaagtctcgtttccaaggccacactgctaaccgggagtggtggcaggtgtctgtaatcccagttacttgggaggctgaggcaggagaattgcttgaacccaggaggtagaggttgcagtgagccgagatcgcgccactacactscagcctgggwgacaagagcagaactctatctcaaaacaaaacaaaacaaacagaaaagaactgaagcacagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctstattatctatcagctactatgtgccaggaattgtaggctgaggagatgtgacaataaacacaattgccagagttcctactctcatggatttttaataagtgcaataaagcaaactaaaatagggaaaagggatgtaaagcaaactaaaatagggaaaagggatgtagagtaaaagggtgcttttgtggataagatgctttaaacagagaatatctttgagtggaggcaggaatcaagtgtggaggcagacatgcgctctgtgtctgcagctaagatagctttgtaattagcattttctaaatacaggaaaacatgattgtctttattgggtagcgtgaaacatgccatgactatcttgaggtgtgtgtgtggggtgtgtgtgtgtgtgttgatcaaatcctttcccagaccagaaagagcaagaaaaggtcagcctaagttgtataaacaaagaggatttggaggcttcaggttaataaagttttgtggggtttagagagccatggaggcggtgttcataaaaatagagaacccaaccagacagaagtttgtgtgtgtttgagacatgagtctttggtgtctacacaccaaaaatcagttatacctggagaaataattatgacattttcaacagaaaagtatttaggcatggttaagatctgacccccacaaaagattgaggaaaaattgatgagttcagcaacagccaataaaaagtcatgggaagactgaatgttggagtttagttacctttgggtctgagaaactgcattatattcccataaaagactgaagattaagccatattcctctctctgtgcattatattccttcttttttcttttttccctaacagaattttagttgcttgaaaagaattaacatagagcagaattttgaatatggctaggattagctattgtagcataaggtaagtggaaaagaaccccttgtcatgttgagtttttggaatgtctagacatgaataaaaattaaaaggtatcattgattgtttctgttttaatgagtataaagtgaattgggcaattcacaggctaactccaaccattttgggcttcctgatgactagggccaagatatttcaaagagtactaggtgatttattgggtcttatgcaattattattccaagaagagagatgtcgtgtccttggcttatgggtctggaacctactcatgcatctgtctatccaggcttctgtccatgcatccaagaggcttttatggagctctgtgaatgtcacaaagatgaatcaggcatgccctctgttcccaaaaagctcacagcacagccacagatgaggaaatagagaattatgttttttaaagtagggtaagtgtaggatggtggcaagggttagatgttttgggattgggggtaatgatcccaaattggattagagcacctggtaacagtttctcagaaacgctgatgattatgttcatcctagagaagaatgtgtggaggttgtgcaggcacagaaggaagaaagaggttttccaggaagagggaattgtacaagcctgggcagaggcacaaaggggtggaagagcaagattcactcagggaattgcagtaaattggcaygactggagtccagactacatgtttggtcaggcagtggggtaggtatagaaaaggaaagaatggccaagagtgagagactcagagtatttgggatagagttatgagaggcctgggggacactataatgaacttggatttgatgctagtagctctgaggaaccatgtatgtaatttaaattgaaggtgtctcactaagatgatggaagttccattgggctcctatggggtgagtagaattctatggcaattttttgcaataattatggcacaagagtgaggccaagagtaaatgatctggagtgtgagaagccacttaattctttgtatgttggtccttaaggtgtaagcatccctttcatggaccttttgtaggtccaatgaatgacctcaacatgaaaccttgcagataattttgaaagaaaaggaaaaaaaactcttcaatcatgaaaaggtctccattatatttccaagctatgtgaaaatttttattatatatcaattactttggaaacatggccattgcatgacactgtttctcattcatgaagggaacacttctgttttgaatccccagcggtgcctggtgtagtgcctgagacagagaagaagcttagtaaatgttcaaggtattggtttgctaatgatccaaaccaagctgtgtttgggcccatttgaacatttaccgaaccatgttgttaaatataaggaatgtcagtaataaccacaaaagtaagtcagtaaagacaatagagcaatgtcttagtagttatcatctactgaagatctgctcttagctaggcatggtcgcaggctctttatgcctcatttcactaaatccttaccatccccacactgtgtctgttttattatccccctttacagttgggaacactgaggttaactgtgtttactcaacaatctcagggtcacacagatgcagagtagaaaagcaggatgtgatcctaggactaaaggcagacaaagtctatgccttttctctcctattgcagtttccacatatcagcaggtacttcctgtgaaagrggaagcacatttgttctcctggctccagagaagagaaagcagactggcagctctcccatgagggaaagaggagaactttgacaggaatttacgaccaccagggagaacagaactaacttttctgtaaggctgtggccacctacccctgaagatgagatgctgatgtagaaaatggacagccatctcttagaggatctgcaaaataatttctattctgrttagaaaaattaaatacattcactttatctttatgatcttgagatattccttggatagtaacaacagctcctgacatctggagactatttcattttagacaaaacatttgcatggagaatctaatatgatcccatgtgacattctttttgggacaaggtagctgttgctcagagaagcagcaggaattgtccaaggacacacagggtgaatgaaagacttggcagtgggacctgggtycaataatttcaagaccagtgctccttcacctatgcatgttgtctactggagtgaagcaaaaatatgggtctatagggcagtrttatgcagaatgagtagtttctttccattattagcataagccatactctgaagctatttctgagacagtcatccttttctatgtgggtcaatgttcctgcagcatggacttccttctgggaacaaagcatcctttaggatcttccttaatcatcctcatcagtgtaatatgttgcttcctgtccaactgtgccccatttccataggcaatttatctgtatccatagagacaccagagatctgcttcttacttcaaatgtttcatatctaggttattcttcctgacrtgtgagtccagggcacaagtctaaagctcccacttacacagcccagagggactgagccctgctttccacagtcaggtcaggagcacactgactcctgactgtggaaaatttgtctgtgtgctaagtgtaaacagatgtccccagctgccggatcctttggccatatgaaaccaatcaccaactctacacaaacatgcatcatcaggctaaaatctgaaggtgcaatgaactcaccctgcttcccataggacagtgggtgagtagaggctgtggggagtttggtcagagcagtccatctaagggcaaaatttgtgtggtttaatgagatgaaagtggtgaagcggggccaaaggaagtgcagctcagagttaggatagatactggttcaatatcatctggacactttcaaccctgtacacatgggggcactaaggtttgggggtagaagtgacttcctcatgatctcatagcactctagtgattccctcagggtttaatcacagatcagaatgcccaggccagtactcattccattatgtaaggctgcctatgacactggctttcccttgagcttcttcatgtggagtccttgcatctcttatgttttaaatcctggcagttttggattgacttttctaagccatgtgaactttcctaaaggataaaaatgatgatgccattgattgtgggttaatattaggttagcctagatgttctatgtacttaattgcattaatagccctaacgtaccatgaagtaggtcttctattttaaagaagaagaagctgatactcagaaatggaaagagggttgmctaaggacacagcttttagatggcacagcctgaattcacatcaagacaagttccaaagacatagtttaaagaatcaacgaagttatactgaggcatctgattgacaatataagatggctgcatgattaatattatttattcacttaaaagaatttattgagcatttattatgtgtctggcagtatatgtggtttcaaagttgagcatgacattattctattaagaaaacagtgtagtggtggagttggaaatacaaacaaacccctcatttatgttgaagcaattgttaaatggatgattgatcaggtataattggaatagagtaaaaggagtgcatcagtttgtctaaagggtaagagatggtttgtcagaagaggtgacacttttctatcaaataggtgaggatggaattcaaagcagaagttgacagtctgtttagagaagtgaaaacagaacaaattatggaattgtggaatacttagggaaatacaggtcattaggtattgttaatttgttaaaatataagcagggaagctaaaaagatgatattaaatatacaggttacaaggaccttataggttttactaagggagttagaattgttctctgagggcaattggaaaccatggattggttttaaacaaaaaacgcatgatggacgtattgtttaggattggatttgattgttagtaatgtgaaactctaaattaatactggcctaaaaacagtaggagtttgtttttcatstaaaagtctggcgttacatrgtcgaggattaatatgatggctgtttaggaattcaatattttttcaaccatccccrtatgtgaccttcagactcacattctaaacctataatcagggcaacaaggtggaaacaatggtaaataagaagagagttacacagaggtaccagtgttcttttaaggaaggtcctcagaagcttgcacaagacacttctgcttttatcttatacatcagaacttagttacatgtctacactcagctgcattaaaggttgggaaatacagtctttgctctggatggtcaagagcccatataaaaaatcaggctttgtggttttctgctagaactgaaggatggatattgaggcaagttatcagtaagtattttcatattaaagagatcactttaataactctgtggaagatggacaaagatatagggaagacactgaagatatgagactgaggctggtgataaccatgaggctggggaatgctttccctttcaaatgacctaggctttgcccaattaaggaaattactgtcttagagttacttcttttctattgagtcagaggtagatatatgtctccttcagcaaatgagtcatacccaaggttgggtaaacttgtttagatatgcagagtgaaccacgatatgaacctggtttggactgtatccttcacagacttaaaactctgctcatcattcttgtgtcctcaaatagccagatcagattttttattctgattttctatagagctaagataggtaagaggaagtttctatccatttcattctggttagctgagttaacatgttttgtctgttaaatattcatggaattaggataagaacatgagttttagaaccaagaaaaatgggaatgaaaaactcagctctggtactaatcccaggttgtctggtttgtgagttagtcctgatcatcaccacaccatatggcatcctctggctcttggtttacttttccctcttccttaagctgttcattttcaagtaacatggggaaagtcacaccagtcttactgagtatccctaaaaaatggaggcagaagaatggacttgatgatagaaaaatttattcttgggcactaagcgtgctcagctggctatgtctacctccatacctcccctttaatatttttctcctggcccaacaagtatgtccagggccctataaaggaaataatccagcatatgtctaatgttggctcacccagtcctcatcagctttgagccatctcactttgcttctaatattcctaaagcccctcttcttcagagtccctactcctctattttactcagtttctcttgattctatatcatggcttcattcttctctacagtgtttctaggaatacgaaagagtagggatgttgtctgaaaactccaaggttgagatataacatactgtttaataacagagatgctgaaatcaaactggtatgaatttacatctttcccttactactattaattctggaccttaagtaagttgtgtacctttttcaagtttcctcatctgtaagaaggaggacaataataattcctatcttgtatgttattgtcagaatttaatgagttaacaaatatatgtaatatatatgttttwtatatatatacacattttggtttagtgtttggcatatagttaagtacaaaataaatattagctattgatattaattttggggttggaggtcaagaaataaggctggaaagttgggaggctccattgtgaagagtgacttaatgattaagaagctggattttgggcaagaaaaaagaggggctttggacaggagagtgcattcattttctattgctgccgcacaacatgaaacttagtggtctgaaacaacacagactcacagttctggagatcagatgtgtaacatggtaggcagattgcattcctctggttttggggaagccgtacctttctcagcttctagaggttctccatattccctggctggtggccaagcatattccgaattctgcttccrttgccacatcttcgtgtctgcctgactctactgtgtctctctcacaagaacttttgtcccagatagtccaggacwatctccccatctcaagatccttaatttaattacattggcaaagtcccttttgccatgtaaagtaacaaatttgcaagttctggggattagaatttgggctttgatggaggacatttcagcctaccacagaaagtaacatggctgtctggggattttccaggatagcttgtgagattagagttaggaaggccagttaagatgctgttgtgagaatgtgagaatgctgttgtgagaatgttgtggggaatgtgaatgtaagcattaggggcaatcaggacactggggaggaatggctgctgaagaactaaaatcaccaagacttggctaatgagattaggagaagggcttctttctagatttctagctgcagggactttcagctaggggatggtggtgtcagcaggagctggcaaataccaggggaggtgaccgacacattgactaaggctttctgagaaatcttgcttcctgtagcctgcagccattcgttataaaacacagagagcagtctggcccagaacagagtttcccacayttcactcattcttaacaactttttccaaacctgtctttttaatgtttcaatttctgaatatttttctttaaatagactccagtaaaagtagcttcatcctaaacaattagtttcacaaaaccacaactctgatatgcctggatatttggatgcacatactattcatacatactcattaaaatggaaatgtatttttccatgcaccagctaaaattatttctcaaaccatcagtgctaagcaaaccacatatatgcaaatgtcggggaaatgacaaraacacagactgagagattcaaacctagacttgagtgtatcacttgagtccctggacttttatttcctcatatgtgaaataaagataatgtctaacttataataacttagttagataattagtgtatggaaaatgcaaggtrccatatcttataacaggaacccagcctattatatgcatttatattgttgaatcttgtgatgttttttccttatatattaaataagtcagtcttktcataagacctgtcagttaattttgataaacacactagggaattcatcgtctttgcagtctaggtggcaaagcaattttacttactgttttttattacctcatgagtcttctttacttccagggtacttctttacttccagaggaggtatggaggtatggaggtagacatagccagctgagcacacttagtgaccaagaataaattcttctatcgtcaagtccattctcctgcctccactttttagggatactcaataagactgatgtgactttccccatgttacttgaaaatgaacagtttaaggaagagggaaaagtaaaccaagagccagaggatcaagtgaccacgaggggcttagggaaggcattcatccctgttgactgtgctaggagaaccctgggtcaggagatgctggactcctgggatagaaaacctagttcttttcaaagatttaaagtaaaggtttgaggtggaaagccctactgttttctggactatattagaatcattcctctcctcatggctgtggatcatattgcttataaaataccagcctcgtgacccatttgagaacatcactgaaggtccacaagataggaccaaatgggttttaaaaaacaccccagggtctctccctactgaatccctacccagtctaacagaattagactcaaagcagcatttgcagaagatagccctgtttgcatgagctttccaatgatacatctggttttccttttgaaaaaggccctcaaacctcataaaactgaagtcctttgattcaaaccacaaattccttatagctaacctcagcaaaactccttacacactctgagtacttagtccctgtaacccttattcctcttttctcttccatcttcattaagttagtgggagccaagcttacaaggataaatctgattgttttgttcaattcacttcatattaataaaaattatgggtcatttttctgccttagacctttgctttagaatagctactatttattaaactctaactatggccaagtacattacatagcatcccacttaaacttacaacaggcttacaaagtaggtggtatttttccagtctttccaatgaggaaagagaaacaagcaaacaaacaaaagttattgtttcattgtcttcctgctgctagatgatagatctagtaattcaaatccagtcggtataactccaaagccctcacttctcaagtttgtctctctatataacagattcctaagagttaattttcaaatacgatttgatattttaacaattcctcatttgcctcaggcaattgttatcctgattattgacttcatggtgatgacaattattgctactatgaataacagctcttatcctctaagtgttatactgtgcattttatataccttgaatacaataacttcttgaggcaagtattattatctccttttataaatttgtaaactgagatgcaaaaggtttgttaacatttccatgatcacagagcactgaattaatgggaactgcaaatactaacaaaaaggaaaactttgtacatgccagcacttttgaaatatattttacatggttaactcatttaatccccacaacaaccctgtaaggtagatagcattatcatctgccttgcacaagtgaggaaactgaggcacagagaaataaaatgattattcaaggtcacacaagataatcagtgaaagagctagagtgtgaatcagtatggccttgggtctgactcagagcttgttatcacagcaccatgctgcctaactatctgactgcaaagttcctctttgctctgggcaggtacctatgtgagtgaacttgaaactctatcactcattccaattcttttattcactggtgatctcactatgttgaaaggacaggatttgatgcatgccgtgtcagtggtgatcactgttattgagatagatttgcaccgatgtctgggagtttggactgaatgttaataacatacaaaggtgacctgcaataaatacacagctctgtcagaaagctagaggtctgcttggcagagagagtcatcatggattgtggcagattctccttctgtcaaggcttatctgaaggctaaataaatcatgctggaatcttctgggatgttggaagagaggaaaaagtatgtattggatgggggtagggatgtggaggaggttcagatggaaatggaatattgattagaacaaaggtgaacttgatgtcagccagtgttctttttagaaatgaagggccaggaatggaagttaaaaaagagaaatattttctttaattgcaggcatagaaatagagaaatcaacatctgaagaaattctaagtgacacactgggctctagatagatgttactctatgtttgattctcaatttttttgatctaatgtttctgcaactatgaagatgtagctacactacagcataaagtgaactccttcacaatgaaaatttatttgacacatattaattgataactgacagctataaattcacatttagattgacttcaatataaaatattcacttaaattgctgtgtagtcacatttcttaactttcccaacttttcaagtataaatgatgcctgatgtttggcattagttttgaggattcccaagaacagctatctataccaacgtttaagaagcatcttcatagtgcagatttatagaaagatatcctccagcaatacagaggctatgtgaaaagcagtgtgaaggtgacagatatttgtcacctatgttatgtcaggcactgtgctaagtattatatatgtagcatctcatttaataataacaactgacatgcagagttgttattattaatccccattttatagacaaacatttccaggactctgagttatattgcacaaggctccttgatgttctcatcatgcagcagaatttgaaaaccagtctgtctgatttcaaaacttgtgttcttttaccagaacaccatacactgcctctcagagtaaaggagagataaatcagtgaggacagctaagttgggaggtcaggagactctctctcctggaagagaaacaccgaactaaaacaaaaccatgaagttcagtgttctaatttagaacaccaacctttgaagtcccatattctggcctttgctgggtatagaatacgagccatctcatgctctaagatggctggtaacctttatctctttcttccaggttagaaagttagctgtttctgaaggcattaatcttagtgagaaaatatatcatacattgtaattcattatgccacacagttcgttcattcattcaaaaatgttttctggtagattgactgaaaaaagtagctctggttttatttatttatttatttatttatttatttatttatttattttctcttcccatacccattgcaatgtgacattgcagattttatcaagaggtagtctatttcaccatgattttaatctgggctctccttgtatcttgttttgtccaaaagaaggtggcagaagtgacaatgtgccacttttgattgtagattatgagaggctttacatgcttctgtttctctcccctgctcttgcatccatcatgctatgggaacaaaatcaggccagaatacaggaggtgaagagagacacatgcacacagccacacacagaagcagagctgcctgattgaacacagctaacctcatgttcatgagggaacccagcagaaaccgaaagagccacctagctaagcctgctttaagttgctgacccaccgaattgtgagctaaataaatggttgtggcttcagccactaggttttgggctggtttgttctgcagcaccagataactgatatctattcactaaaatgcacttgggtgccaacattgtggcatgctgtggggacatagaggtgattaagttatgttccctgttctgaaagagccggcactccaaataggaagtcagacatgtaaacaaatgacaacatagcaagttatgggattaatcaaagtaactggtgaactccttttagtaggaatagttctatttcctctgtaaagaaaccactatgatagggagcacagtaccagttggttccaataattcttgtgatagtgtcatccaaacctcagactgcatcagtggtcactcagcaaggagccttgaagattacccaatgctatttatatctattatatgatcctcattaagtaacctcaaaggggaggcaggagcttggaaccagagctttttggaagaatttctttaaagggatagtattctgtgattaaattagaaatagcaagatacttgggagtactgattaaaaattttagtcttttggacttttaatgactgaaaaaattaatagagctctaggctccagaaatcaggaacttgctgagtatctcttttttttatttttcagagaggaaactatagcagctggcagatagattagtgtaaagaagctacacttgggtttgaatcccagctgagccactcagttacttgatcttttgctggtttctgaatctccatacattttgtggtgcttatgtctaaacagggataaagatatttactttataagtttatgatgaggactaaatgtaccaggcacataattaatgttaatactttccccattccttcatttttaattctcctttgctttctgttgccattttctacttttttcaaaagaatctgttggagccccaatacattaaccttcatgaaattgggtcctgaccatccgtgaaatggatgagtttgaacacttccccaatgtcggtctgtaaaagcacattttgaaagtggctttgaaggactgtttgaataataagatctattcatgatcacagagggccgagacaaaaggctgagacaagtctgtttggagaaaactctgtgtggaatgtcaatgcacatattagaacccagcctgtcaatttggtccacagagagaatggtggttttatgacattattggcaccacaatctaacaactctcaaccggctggggcattaaacatgacgaaggacacagatagactaccctagattttttttattcaaagggagcacatgtaatgttctcatgcaaaccagagaggaagtgagaattctttcatcttccttttctttgctattaacctcaatcacataactcttgggttaattttccttctataacgagaacaccaaacagaaaacacatgtgagaattaaataaacacagagtagaatgaaggctgaatctatggaatctatcaggacttgtttacagagaaggtaaattaacaatttcttggaggcacagttttcttacctgtatgataggaagaatcactgttggaataggcattagtgttagggatgcttctagaaagcctctctactagcatactttctagtctcaggacctttgcacatactggctctctatctagagatcccttccttgccgagatgtttttaggttaactcctcaaatttattctggcctttttccaaatgtcatcttctcacagggaacttccttaattatcttatccaaaattgtcatcctattaccgtctacctcctcattctggttgatttttacattggagcatctatctgatattgtatcatatatttacatgctgccttattaattgttcatctcctacaatcaagtgacagtctcacaaggtggggactttatctgctttgttcacttctgtgtccccaacacctataatagtacctgctacataggaaacactcaagcatttgctaaatgaatgaataagtaaataaacatgcaagattgttttggcaccaaaaattacagcatatagtaggcattctataactgttggcagaattaacgagtgtgcatatccatctgtgagcagaattagggaatcaccactctccagcaagccagtgtctctctcacttcacacccctgcagattgcataaggaatgtccagacactttctgtttccagaatgatgtaatgtggaaggagaagacctgcagaacatgttgctcacagacgagacagatgatctcatccccttcctgggcattcccaggctttgctattaaaaaaaaaaaaaaaagaaaagctgcaatgttcaattcacaggtggctgtttagtcctcagccgtttattggcaaaatactttaactcatctcttagctccctggtggctgggaggaggagaggaaagtcatgtcagatatcatctggcctatttcttcagccaaatggaatagatttaccctgagaaactaggacataaagggagagaagtgcactttagcatcagccacaggggacaagctgtgagcaaggggtgatgggggagtttaaaaaacaaagtaagccaagtgtttcattgacaccagagagctgagattgttcttgggattatttcaaaagtctagagcctgaagaaatgatgtacccaatatccctcacgtggctcatttttatttgaaaaatcctttagttttgatgtctgtgtatatattaaactgatcagaatttcaatttataggtatttattactctacggtttataacacatttcaatacacagatcttcacaaaagtcctgaaagtgaggggtatagaatgatccccctttatagttgaggaagctgagtttcagagaggggaggtaaattagccaagattgcacagctagagagcagcggagttgccattggaactcagatctagttatctttaagtgcaaatctccaaccaaatcttcaattcaagacttaaaaggtgacctgcttgtcagctacagtgtttgtatgcctcaaaggtttcccacatctcttttttccgtggttagctattagacaccttatttcagatctggggcagtttgggatggcaagtctgtgcacaaatcaagctgaagtccagttggatgtctcctgaacaattagtagttttgcaccgatttattaataagccaaatagtactgtcgactccaccctccaaactcgcccctcctctcttttctatccccttcccaccaagatgttttatttattttttttcagaagttggtgttagcagctggtcaagtcctaaatacaaaatcatcctttccacaaccatgtttcccatccaatccatgataaaattatccaattttcattgccaaaatgcaccttgactctgtccctttttctccatctttatggccaccaccttagttcaggccaccaatcctgagccttaggttattatatctgcctcacagctgctgactctccttccactcttgcttctctcattcatcatatgcaatgaacacaagagcaggtgtttttgcatacacccatttttttgtgtgcttaacctctcaaggcattttgatgcatttacaaaatcctgaagccttaacgggaccataggctcggcttgatctagcccttggcaaccttgacaaacttatttgtgcccatttcacacttgcttattttattctattccagaagctgctgtgtagagagaaagctgctgctgctgctttttttttttttttttttttttgagatggagtctcattctgtcaccaaggctgcagtagtgcagtgacacagtcttggctcactgcaatctctgcctcctgggttaaagtgattctcctgcctcagtcttccaagtagctgggattacaggcacgtgccgccatgcccagctaatttttgtatttttagtagagatggggttttgccatgttggccaggctggtcttgagttcccgaccttaggtgatctgcctgccttggcctcccaaaatgctgggattacaggcatgagccaccacaggtagccaagagaggtagcttcttgagagtaaaacacaccaagaagaaagtagagcttggatgctatgagagcgtgaacactggcgatattgtttgaggccctgagtgcatttatgccttaagtgctgcattgagttattgagccaatatatcttttcctctgtgtttttttaaatcaaaatcaagttgatttgagtttattgtcacttgcaacaaaatatttctggatttccacaaattcacaatcagttggggaaaagtcgatatgtgaacaggtaaacactgaaaatagatggtttgtatgatacaggtgaacacgagggcctttaaccagtgtgggtgttgaggtgggggaaagtgtccacttccctccaggagacaatatctggtctgaatcttgaaatatacttagcagttgtcatgatgtatctatcaaacagaggatggcagagagacattccagggagaagagaaggcatgagtcaaggcatggcgtgaaatgggatgatagtttctgggaactacacgtcactcatactagctttaatgcagcctggatggtgaaggcaaagggagagatgctacagagaaaggcacaggccatactgtgaagtgtccaatagtttgtcctaacaagataatgttatcctgggaattttgagagagcattgagaaattaatttttccactttaaaaatgaacattctaatccttccccagcctatgtaccataaaagatgatggtgaaggtctcttagtaaaacgtctgtgaaaatgctttgaaccaggtataaattggctaattatactatggaaaacagaaactggaatatgtttgatgtcttctagtttccaggccctggacaaggagagagaatctgatatggtttgactgtgtccccacccaaatctcttcttgaattgtagatcccacaattcccatgtgttatgggagggatctggtgagaagtaattgattcatgggggccggtctttcccatgctgttcctgtgttagtgaataagtcttatgaaatctgatggttttataaaggggagtttacctgcataacttcccttctcttgtctgctgccatgtgagacttgcttttcacctccttccatgattgtgaggcctccccagccacgtggaactgtgagtccattaaaactctttcttttgtaaattgcacagtctcggttatatctttatcagaagcgtgaaacggactaatacggactcaacacagaaaggagaagttgagaggatgtgtaggtgggttttgtgtcccatgagatttcagttcctggcagtgaagacctcaatggtggggcacccttggaagttgggccacatccttatagtgagaggagaaaacactgcttgtgtagttagcctatttcacaactgaccagagtagggcctgctccctacccttctgtgcctccccgttgcatcccaataacatgatcccaaagtagtgtttctgattcttaagttcaaacaacttcagtggtcaggaactttgttcccagaaactgtttccccacgtcccttcttatattacttcctgtatgtgttaacactctccccacccaaccctcggtcattatatagttgaacaaagccaagagtatgccacagtggcaggttcgcacatagtcagccccagcttcagtgtggggacatgattgaattctcggcggctttgaagcctggaaagcagggttgtaattgacaatgcaccaggacaagcatttgttctcatggggggtctcccatccgtgagatcaagaatcctaaagccacatttttggcatcagcctccctggaccattcagtatgaccactaagtgttagattgactctgggctgattgcttctgctatttagtgagttgagatgatgagcctgagctctgagatgttgcaatatgagtctgcccaaataaaaccacttaggattgtcacaggaaacaaaataatgtgcctcttcagtttaagggacaacttggctacatttggaatttaaagagtctctcttccttttctcagtcaagggtacaaagtgtgttaaagtaatatgagatgctttggctaagtattcaattatctcattcatttacttaacagttattgagaacctgttctgtgtcagaaatggtgctaggacttagataagctgaataagacactgccctgccctcccaaaacttgccatccaacagtggtgttgagcagtggtgctcactctcaactagaagatgaaggattccatttcctttccagctctgccacagtgctgggaatacttgactgtaaggggagagctttctgtttacaagcattctatttcagcaaacaggggagtatcttataatcaaggcattataagtcctgcagatttaaacttaatctctcaattgctttatttttaatgccacaaatattattcagaaaaaatatatgaacccattaaaaatcagtgcaaggtctggatatataaagaggccacctggctgggtgcagtggctcaggcctgtaatcccagcactttaggatgccgaggcgagtggatcatgaggtcaggagtttgaggccagcctggccaacatggtgaaaccccatctctactaaagacacaaaaaattagccgggcgtggtggtgggcacctgtaaagaatcatttgaacctgagaggcggaggttgcagtgagccgagattgcgccattgcactctagcctgggcaacagggtaagactctgtctcaaaaaaaaaaaaaaaaaaaaaaaaaagaggccacctgaccaaatgttaagggaggaggcaaaaatatttattaaattttgtaattattcctgatagactgcgttgcagaattcaagaatatatatgtctacaaaatgaattaagcacacacaatgttcagttgttaggcaaattggtatttgtggcttgccgattaacaaagaactagacctcaaacaaatcagatgcatccaaagtactggagctctgcaaagctgttagatgacttataatggctggaatctgatatcagaagtttgtataaaatagattcatgaaaactaagagttggaagaaaatgcaattatattgcattaattgaaaatgcaattaatatttctaattttatgacttttaatatgtggtaatttgataaatatcataagtggacattttattatttcatccacatttctaatgtttaactatataggttaaacaaagagacaaacaacttgttgtcttgtgctcgggcacccgtggtaggtggctgatatagctggttggttttcacaaatgtaattccatctctgaatcttggtgccttcatctaggaaatgaaagtgatgaagtgcctgcttcctctctcattttcaatcatggtgctgttcaaggcagtatgctatggaaaattgtacatctacacattggctttgagtttatttaatagcataaatattattcagagaaaatacatgaaaccattaaaaatcaaccttagggctggatatataaaaaggcatgtttccccattttattcctggctcattgagttggaaagcctccttaaacaaacagacctccagaactcagcaaggcctgcccctgctcccagattctaaatgcaaaaaatgaagaatattttctttctcccatttgttgtatagatttagaatttagaagacatctcagaaggaagaaaatgatgggtggcattctgataacattatctcctcactgatgttttgttcttgctgctgttcatatggaacacagtagtaagtgttgtgtgaggaatgcaattacgtttaaaaaaggaggtgtaagaagctattatagttttgaaacacataaaggtgtctaaactcacttttctctgagttgtgttgatctgccacattagccgtccccatggattggaccatcctatgtggtccatgaaatctcccaagatatttcctgtcaaatggcctctgccactgctatatttatttatcttattctacgagactaaaaacatagttcagctatttaggtgggctctgactagctattacagtctacatataacatgattagatacatctgtggaaaggaacgcatggtgagaaaatgttttattttctctaattaatgtatagtcttcagaacagaactttgggtgttctggatttgtgtttggcccatagctgctgcttttcactggagcaggaaaataatgtttaatagctttgtttaaaggttttcgcttgttccaaacttgttgctgtagagtctatctcaatctgtgtgtatttaagaaaaaaggggaaacaggctggaagcaaaattgtgttctggtctccacccaaaacaccccctattttttttctttttttttttttgcaaaccatgaaagccttttaaaagctgctttgattagcttccacatcactccccgcaacatagagtgagatgctggtttgtggcctaggatgagagaaaggggagccgggactctcacgggacagcttggccacttgagtcttccaaacccaataggctttacttaaatcagagatgcactggaaggagaccaggggccttttgagctctttacccatcactaattctggctccagctgtactccgactcgggtgatgaaagagactgaaagcagcaggactcagcaagcattctggactggatctattcaggctgcgtttactcactttgcattatggggtttccatggcaacaggcacatgtttcagcatgttacatgtaaaggggatgtacctgacagtcttcctggtcaggaaaatcggatcatgtgccgcttcttccctggttgtctaaatgggctctaccatgagtcagtctcccttccttccatatgatacccacagagaaagatgctggaagtcagcgtccaagatcctgaaaccaccatggatcccagtggagacatctgagaatagagtctgctccaaagacagctggcatggttgcaatacatcagaaactgaggctgagtctccttccctgctcttacttggctcctggccttggctgggctttgagggccatgaaatgaaaatattttctggatattggccattgtgattgtgttccaaggactgtgatccatgagggagctggtaccaaagaaaactccatgcgtgagcctgggatattcctcccctgcgatgtctgtctattgctcatatgaccaacctgagagctgagtgtttacagtttataggatcatggagtcatattcaaagtcaatctggtttagtatattagagtatgaaaaaacatccactctctttttcttccatttgcattgaccatagtccataaaataggaccccgcatcatctaagaagttttagaaagaaagtattggttctagctgggtgtggtggctcacgcctgtaatcccagcactttgggaggctgagatgggcagattgcctgagctcaggagttcgagaccagactgggcaacatggtgaaaccctgtctctactaaaatccaaaaaaaatcagccaggcatggtggtgcctgcctgtaataccagctacttgggaggctgaggcagaagaaccgcttgaacccaggaggtggaggttgcagtgagctgagattgtgccattgcattccagcttggaaaacaagagtgaaactccttctcagaaaaaaaaaaaaaaaaaaaaaagagaaagcattggttctttctagacttctcttttactcatccccacaggagaaagttagacttctctgatagtgacaagagtctgattttcatctgtgctcatttctctgagggttggagagagtatgctgaagactgtgtgacatgtgtctctcttgactttgtatgtgtctttgtgcctatctttcatactagactgcacttttcatttctttctttatgtagttcaggaatatcatttatggatagttataataattgagagtttaaaaaccagtagccctgaaaacagatctgatccaatgatgcatttttgtctcactcatagagtgattgtaaggttttgctttgaatattaaactttattgagaaactttataataaaatcctgaattttaaatttatcttggaagatctggcaacatgaggtctgcagtaattagcaggaaatgagtgcaggctgctaccctgggtgaggggctctctggtttgccagactgccttctgtgcccacatcatacatctaccatcctggccactccagtgcacgctggagtatgtgattccaagaacaagaggatgtgtgggtgacactaagcgagataattcctgattctctgttgaaagaggtttgtatgttaagtttgtgtgatgtatgacctgtccttttgggtggtttttgaaggctgtacaggaagccaggttgcccataaggctggctagggtaatgcataagctgcaaaaccagcttccccaagtcaagatgctgaggtctcattataacaccagatgtctaggcactgcagagacggcagacaggagggagagggcagcttcacctgggaagaacagggagaatggtactgagttgggctcttgagtgtgaatgggatttcaccaggcacagacagaggagaggaagctttcagagcagaaggatcaagaggtgaaaaaaaagcaactatgaagcacatgaaactcaaaagactataaatgctttggtatgcctaaaatgtaggatgtgtgatagggacctgggagagatgaggcaggtaacaaaaagtccttttctgtcaatggaaaactactgaaggttattttttaatcacttactaattacatcagtgatgcacaattacactctctttgaaaggtctaaaacattatagataaacttcttcttgacatctacctcctaatccttatcacctctttgtctacctagagtagagtttctcagcctcggtactgttggcatttggggatgggtaattctttgctggaggtctctctcctgtgcattgcaggatgtttagtagcatccctggcctccatcactaaatgccagtagtaccacccacccccatgatccacacacagtttccatagccaagaatgtttgtagatattggcaaatttccgggggggcaaaattttcccaagttgagaaccactgacctagcaggaactagtgttatccatttattgataacatgggacctatgtttacatttacctgtagatatatttactaaggaaagtgctctcttttcttgttcacatagttactgttattctatatgtatctcttaacttgcttattctcaagcccatgtatttgggatatctaaaaatgctagtgcctaggaagctgtcgggttttgttttgttttatttttgaaatgtggcatagtattctgtgtagggatatataaccatgtatttatctacatccatgttgttgaacctttagcttgtttgcttctttcatttttcttttttttgtatttcaaataactttgcaattaatgtcctaatacatatttccttatgttgcatacagaagtttgcatcaggaatatggggtagacttgctgttattcatcttcaaaatgactaaaccattaactagattctttgtgcttctcagagaaatgcttctttcctattgaaaacaaccctaaagggaaaggaaaaaagggggacaaagaagagaagggcagaggagagagtgggagcaaagaaaacaaaaaggggtttaccagccactccactgattcaaactacagtgttgctgagcattggttcagaaaaaaaagttgaatagcgcaacagggtatttcagatgtcaaaggagacatcctggcacaacaggagggagggagaaggatgaagcttccaaatttgtttcccaaagcttctcaagacattgccccccaccctctgatttgacgcaaagccaaaaccagctgccttcaacattctttatcccaaagaaatgtgtccctttaattccctcttaagccatttatgtgagacataatttatgttctgaaaaaaaaaatcatatactttccacggacccctacttcctgggctgatagatcagcacagggcttaactctttgatgggaaattaataaattacatcgcccttgttcacctcactgcattagcaggtgtttgtatctgtcaaccttccccatggtctatccatggggaggagacccagaggttttgggattaatcagctctgatctggaggaagatgaaactgaagcatcctgttatggatgggtccttgacaggcattctgccacccaacctgcaagatctggcttcccctgtgaagtattttaacctccttgctcccctgattcaattccctgatgcttcatctcctatatacttgactgtccctaaggtcaagactgcaatgccttaagggcatgatgatgtctaaagcagccccttgctcctgactgtgctatgttgcattcaatttatctaagtaagtcacaaagtcagcccaaactcaaaagatagaggagccacaaagtcaaataacaaaagagactggatacagggaggaaattatagcagttatttttataaactatctacacgaggcaatttatgaagtttataaattcatatactctgtgaccaacaatttcagttttctttttctgagaaataagtacatatgtgttaagacattcattgcaattttatttacagtatcaaaacaacaaccacctcacaaataaactaaagtttcaataatatagttgtagataaacagaatatatccaaactacagaatactataccatatatatatatttttaaatggcagcttcctatatactagcatgtttagacatcctatgtgaagtaagcaaattacaaattggtacatataactaagtatgtgaaaaaggaaaaaaagaacattttctattgctaaatttacctaccagttaatacacagaaataggtgcatgagcatctgtagaaaatggataatactagttatcactaaatctgtgattctctactgggagtgattctgccatcaaggagcatttggcaatgttcgaagaaatttttggttttgacaccccgggggagggaatggtgtggctggcatctagtgggtggaggccagggatgttgttaaacattttacaatgtgcagagatgctccccacagccaaccattatccagtccaaattgctaatcatgctgatgttgagaatgactgccttatattcataagatgtgctgagctccagacatctggagtatccattgtacatttccagttgaatgctcaataagtaagacaaacttaacctgtataaaacactcctttaatgtctacacccctgaacttgcccctcctccaccctgccatcttacctggccactcacctgcctcacttcccacattgactccgtcaaaggacctgttggctctaccttcaaaccataacctgactgtttcttactcccttcggttactttcctatcacctaagtcaggccacctttgtatcttccctaagccacagaaaggggatagggaggatgaggaaggctggcaccatgtggccaggaaaaccactgtttagagaacgaactgatctcagtaaagtgtagtctctgagggagtgttggtgagaattggaatatggaaatctgcccttttttggtaatagaagaaaatgctaaattagaaggggaaaaaagcttcactcatgaaaacagcccactgattttcagggaggctgtccaagctgggtttgcatgtggtaatcagacattgtgagtgggatttagtcagagggcacagtagccctttgtcagggtggctacatggcccacagtttgccatggcaacaggagactgcccagtgttcttagggaggagaagagtgaaaatggtgcttctgggtgagtagaatggggagcctgtgaggtttggggctggcggttgcaatctcagccatttgtggaattgaagtgaatagctgatcaagttcaataagccctggagtttgaatcagagagaccagtttcaacacatcctaactgtctgaccttattaaacatttgagggtctcagtttatttatctgtaaaatgggtttaacaaccctggctgtcagggctcttattaagaccagtactttcttcccgcggtgacaccatcctgtgcagtctgttaagaaggcttcttgagctcatatgcacttggcaggacttgggatcaggtactgccacagtgggatttagagggcagcagaatttcatgttctcattgtaaaaacaaggtcgctatttactgccttagagacttccttaacatcgccacagcaagtaacctaagggaccagtcccaaaagggtggctaaattagaattacccacctttacataaaagaccaggaaatcaatccctccaatcttacattcccattttaatcaattgctacaataaatagagaacatcagccattcattatcacctagattcatcgctaggtggctctgtgtagctcctaaattgaactattttcattcgttcctcatctccccaattttttcactctgtcctctcaaattcatcatctctcatctatatcctcaaattcttcctttgatgcttctctttatctttcttttccaaagggaaaaatggtagaccagaggctctaaggcatactgcagccctcacaaatggtaggttttccttccacatctctagttccctaaggtaggcattttctttactatttcccaacaattctctcctttctcaaaaattaataactgcattgaaaagcataccatcaggctattcttcccacttttgttttggtcatcagccatctcccaagttgcttctccagatggattgaacagtccagctcctacattactgcctttcttttcaagactacttctgtcattatagtgacctcttaaacatctactcacgtagtttaaccttgaactttgtcattgctggtaattgtgcgttttcaagattttgatttcaagctttctacctctgaccatctccttttgttacacaggaattttgtttgcttaggaacattgtaggataaaaacgcaatgttgctgaagatctcactttaaatataagacaaacatctgaaatgtaccctcatcatcttcaggcatttcctctacatttccccaagtaatccctgctccaattttctagcatgactttgtcacattttatcctctgttttcaaactcccatacccttatcccacctctcaccctcatgggtggcctctacagtgacaaattcaatgatcaattttttttattttcacttattcaacctctaaggaccacttggtcctattaatcatagatttctttttgaaacactttcttaattttgttatagggacagcactccttcctcattctctcctggcatattagtcaggattctctagagggacacaactaacagaatatatgtatatatgaaagggaatttattagaagaattgactcacataatcacaagttaaagtcccatgatagggtgtctgcaagttgaggagaaaggaagccagtggtggatctgtcccaagacctcaaaagtagggaagccaaaggtgcagccttcattctgtggccaaaggcctgagagcccttggcaaaccagtggtgtaagtccaagagtccaaaagctgaagaacttggagtctgatgttcaagggcaggaagcatctagcatgagagaaagatgaaggctggaagatccagcaagtctgctcttccatcttctcctgtctgctttgttctagccacactagcagttaattaggtggtgcccacccagattgagggtggttctgcctctcccagtccactgactcaaatgttaatctcctttggcaacacctcacagacatacccaggaacaatactttgcatccttcaatccaatcaagttgacactcagtattaaccatcacacctggtattccagtatttcctatttccttctaaatctcctttcctggtcttttgtcttctgcttgagcactgagtcatagagtttccaagggtttgatcctcctctcccattgttttccattccttttcctctttgctttcttctcttctctctggtttcttaggtattcccaaccagtcccctgacttgaaatattacctatatgttgctgagccccagatttattctctagcatgggtgtcttctctgagcaccacacctgtatctatatctccttttcatcccacttggatgtctataagaggttgatctacacacaacagacctccagatttctaccaccccaaacttacttcttctccagttttccccttaataggacatgttcaactgataatctggttgctcactttcttcactttgcatatccactccatggataagacccatcagctctctctttgcaccatatccagagctatcttctttcactctcctatcaccccaagtcaagccatttttatataatccttaaaccacagacattttctcccaaattgatatcttcttcttacttccctgtggtcttctcaccagtgtcctaagagtaatcctttgaaaagataaatcaagtcataatactgctctcttagccctttaatagaattccttcaaaagtgggatagaatcccaagccatggtcacatcttgtaagcccctaaacagcatctgacctggtccctctttctgagcttaccttctgccactctctccttgccttctctgctctagacatgcagactttcttgctgttactcaaatatgccaaactcacccccatccctgaactttatcgttctttctgttggaacattcatttacagaccttcacatggctaattcccttgcttcattaaagtctttgctcctatattaatcctcagagattatttccttgaccaactcataaaacataagactcctcacctccccagccttcatcactttgtgagccctgattcgatttcatttttcttcattacaccctcagtctgtcaccctttccttattagaatacagtctccattagagcagagaccttggtttttgttaagagtgatatactcagtgcctagatcagtgcctgacacattaattgtccccccaaccccaataattgctgaagaatgaatgaatgagtgagtgctatttttaagatcaaaggagagaagataaaccattaatttagtaccatataaagcacataaacatataataggctgtcaataaaatgagagttgaattcatagcacaacagcaccctacagcctttctaccatgacacttatgttttaaaaattttattaacatgtttttgttgagatacagttcacacattatcaaagtcttctttctaaaacatacaattaagtgatttttagttgtttcacaaagctgctcaatcatcactgctatctaagtctagaatatttatgttaccccaaaagaaaatttagtgtccattagcagtcacttgtggcagtctgccacagttactacttgaggccatcactatgacagttactgctgttactacttgagatcatcattacaagactgaacgaaggaggacaaacatagaaatgaaaacttaaaacaaaagaaactgttttaaagaaggggtccggggaagaagaagagggctccttgcttctagtgagcaaaggcagcagcagccctgagcttctacaacccttcatatttattgaggagaaagagcagggaggaggaagtaatgattggtcagttgcttgattgatcacaggttcccattattgctaacaggcctcagatgtgcgtaatcacaagaaacacttgtgactgggtcgtgacagccctcagcattccttctgggtgacagacgcagtttgtcagtttgccagcattctgcatttatgagaacagtttgctgtttactcatatagcctccagtggtatactgagttgatcatgaccctcactcttttggtctccaacagtcactcccatagtacctcttctcagcccttgataatctaataagccactttctgtttctatggagtttgcctattctggctattttatataagtataatagaatcatagaatatgtgcctgtttgtatctggcttctttcacttaccatgatgttttaaaggttcattcacattgtagaatgtatcagtactttggacttttttatagctgaatagtattccattatatgaaaacatatgtccacacataaacttgtacacaaatgtttatcacatagcattacccataatagccaaaaggtgaaacaaaccaatgtttatcaattaatgaatgaattttttatttagggagctgggagctccctaatggcaggaactgtgtcttattcacagttttgtacataagagatgttaggtaaatgtttatgtaatgaataaataaatgcatagctatgactactataataatatgcaataattaactattatattgacaataatgataataacaatattcagaatgatggaaattactgcttgattgaccttgttaggtttctgattctttagatttcagtccatttattaataaaattgggcttatagtgatggttaacatgagatcagggatataatcattattcctatgcataaggttagttccccattgcaatccactttgccagaactgccatatgtgtcataacaacaggcgatcgctgggcatttaagatatgtattactaaccaagagtaaagtttccaccgcttgagaattctgtgtatcaaagttccagttctttaggatgaaaattatacttattctcttggatagtataaagttagttacaaaatgttatgaatctctgaggaaaagttgaggtaatacatattttagaattttaatgtttgttctatgtttttctaatttcaataaaatcactaaatcacaagattcctaagttgaggctatatctttattgttgtgactttagtgacaagcagagtggttagcacttagtaggtacccttttaatgttttacagatgactaaagagacagtatttgatataaaaaggtgtgaacccaatgctccacagattttgttcaaagaaataccagcagcagtgaattgaggcagagccattgaaggaaattacatctctgggacaagagctttttcccagctggacttctttttgaaaaaggggtatgacctcacacacacaggcagaccctcttccactgcaccatggcgaggcaggcagagactcatccacccaggctctgggtgactagcttgctgcaggagcaagccctatcgtgggacatcaattatataagccacagcatttcagactgagggacaaaagtagattatttgtggtggggacagagacagtcattttaagcaatatcttaaatgaaaagccagtcttcgtggctgagctttggggagactaacctcagagccatatggctgttgggaatggggaggctaatttcatctgtaaaatgataggcctggatgagataataatcacttttgtctctcccagccctgaatactctgtggcttctccaagaaactctaatgaggggaatgtagaatcccagaacacccatggccttaggagagccttgagagatctatgcactgccctcagggtactgctgagggttttttgactttttctgtagctgtgtacatccagtttctctctctgtgtgagttcagagcccctcctctgctcactcatgctcacctatgcgcacctctgtgtacacacatgttacctacacaacagagctgtggtccctgagggaggaagattttcagttaagctctagtttccgaagctatctctgtcactgctgtcactggtgtgcttctaaagcagaactctaacttccatctgtaaaattttctatagcatccattgccgttgggttgaagtcgaaatccttgtcactgcacccaagtcccttcaggcagagggcagccaacatcttcaggaccatccctagcacccatttcctcagaatttcttctccagctgaaataaatgattctttccttccttccttccttccttccttccttccttccttcctccctccctcctttcctccctcccttccttcctttttccctccctttccctcctcttttctgcccttcctccccactcatgtcccctcccctctcctcccctcccctcctctcccctcctctcccctcctctcccctccccttccatcccctcccttcccctccccttccttctctccttctctcctctcctttccttcctttccttaccttctttcctttctcttcttccatccctcctttcttttctttttttctttgtttcttccttcctacctaccttcctttcttccctttttcttcacatagattatgtcttctctcacctggagcctttgcaaatattgcttgttttatgctttcacaagaacatgagtgatttttaaatatgtaaatctgaccacaactctctcctgctaaaccctgaatggctccacatcatagttagaataaaattcaaacatctcaccctccctatgtggccttatggaagctggccttgccttccttcttcacacagttttatgtcctctttggcctccctgtaacagccatagtcaccttctttttgtgccaagaacctgctacacctgctctgaaagtcagaatttcatgctagcacttctctttgtctgcaggttattggttcccatcactgcctggctggtttcttttcctctctggtttcaactgaaaaggaacttccttagagaggacttttttgtccacagaatctcaagtagcttatttcccctgaagtctgctttatttccttcatggcacaaataacttgttgatattttgttaataatttatttttggtcagctggctgaagagttgacactataagatcaaaaatcttgtctatctcattcaagactctatccccagtgtctcaaacagttgttcctagaacatactaggtacttaggacttgtttgttgaatgaattaatgaattaattaatgaacaaatgcttgaacatctattactcagcttttcctttctttcacatgaataacttctatgtatcttttagctgcttatttaaacatcacttcctcctggaagcctttccggaccctggaggatgagctagatgatcctcacctgtgttcccttagcagccaaatagatgacgggattggggagattaattgcacctgtaaaatgataggcctggatgagataacaatcactcttatctctcccagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccaggtaagattgatgatgctgaagtcttatttcctctcaacttctcgttttccccttgacgatattcttttcaggagcaaaaactgtaacctgtacattgttacattcctggtgcttagctcagttgtgagcagttgagtgattttagaaactcagaataaattatttattctcttgctaaaaatatgacgtgctttctaggtagtcactgtactggcctctatgttaaattctctcaaggaggagaatggagaaccattaatcaaatgcctactaagtgttagtgttttacacaaatattcttcttgtattctcacaaaaggccttaataggagtaaacgctgactccattttataaacgtaggaattgaggctcagaggataattatctggtcgagctagaaaataggagtagtgtcctaactctacaatttctgctctttccactaaaccacggctgtactcccaatggtagggaatgaacaacagggctctcctaataattttattagccattctcaaattaatagctcctctgctggcccctcagaaagggggcttcatttagaagtctagcctcacaagtaagaacaactctggttccaggtacccattgggaagtggctgattgaagccagtgtcactccttgtcaggccccaattggcctgccccttccagtaggtcactcaacgtctgaccccagcagtgttttctagcaactctattctgcccatagataagggaaataaatggagaggcattcatagctggctggtgatgatttgtttgttgaaagaaagggtattggatgcaattctgagtgtactggtgccaggttctttcctccttggcatttaggtaactgccagggcttgtgtctgatcttcatattctccagtctaggcaggaaccagcttggtcaggttgttccctctgctgcttgacaccctgcttgacctctgctgactcatctaccaccctctcttagcatcctcataagttactaatggagttcagggggaagaacagctgccagaaatatgtgggcaaatgaaagtcctacattttaaagacaagttaaagctgaactgttccggataaaccagcagctttgtcttcctgtcggtcctctctaaatactcagtgtaaaaactgctgccttagtgagaactcttcctcactctggaaggagctttctctccttccacagagtctcgcccttggatagttacacgtagtcgtcctttctttttcattgttgatggggacagatgtcagagaaccggggtacaagtcaagacacccgactggaggacctactctagttaccaactcgtggcataaccttgggaaagtcatttcatctctttcaacattgatttactgagccattgagtggttcaaatatgtagtggtacgcattgtaatcttaagacgtttctgactctctctctctttttcttttttccttgggaaggttcttgctctgtcacccaggctggagtgcagtggcatgaccatggctcactgcaaccttcacctttcctgctcttgaactcctgggctcaagcaatccttccaccttgagctcccaaagtgctgagattacaggtgtgagccactgcgcccagctgactttttaattttgctattttaaagctatatgaaaagacagagaaaagtgcccacagtatattaagtaggaaaagcaagttgcagtatagtcattagaatatcatacatttgttcaaatgcatgttttcatatcatgtattgttttcataatttaaaataactaccaatacatcataagcaatctttagtaagtttatcatttgattgctcaatttattccaaagcctgtatgactgtctatttaatattagatgtttgagacacagaaaacacaaaaaaactcattgtcctagaggagcctaaagtttatagaatttatgaggacttatgtttcatttctaaaagattttgggaagtttttctgttgaggttgggctgcctctgtgtctgataactaggaagaacaccaacagctccttttctacaagaggtgtattgttcccattctcttcagtgccacatccttgctttagtgcttccactgaccttgtgcttcctgaactcctacgtaaccttagtttgtgtcagtaatgtagtacttaataatacagcatcttctctccttagcccacctcctcaccatcagctcacctcctcaccatcctttctttccctagcccaccccaatcaggttctgtctgctctgttccactgaaaattttcttgttaaggttacaatgttgaagatgttttgctaaaaaaaaccaaaaggccaaaatccatgcttgcaacaattccaagaaattggtgaattgctgaggatgctgcctttcattctctggtccctgcttacacctgcagtctcacctccactttgcagctttattgtgtctttctcaccaccaaaccttcattcatgctgctctctccctgcctggaatgcccagcttcttcatctccaattagaaaattctcgctcacttttgcagtaaatgcctttctgttttatttctcccaagcctttttttttttttccagtttaggtatcatctatttcttctttccagaggaccctaatttctctttggggaattttatctcccctattgttggcagggataccctgctgatctttaatctaactcatttggtacagtcgtagaatgggcattgacccatgctaggccaactgggctttttcccaggagaatgcataaaatgtatggattcattcatttcagcaggccatctgggtccagatatcaggccatttttgcctccaacaccgtctagtgttacctcttttctatttcaagtctcttttttcgacattgtctcgtggccctcagagctgaccctccgagcttgttcataagctcccaacacatggctttttttcaagttatccaaagttggtttctgctccttgcaattgaacaacaataacaacaacaagaacaagaaaagactgatacattcttctagactcagataagggaataccttctctgcaactttttcaggcttcctcttttgtcccttcattggcctctagttgctctaatagattcctccactgtggcattataactgacctcttctctcctaattatagtctccttttgggggttagagatcatgtctcattccaagttttgttcctagagcctaagacatctttatcttgctggggcccggatcacattcattcaggagtgaatgaagaacctgaaattttgtacctatggggttagtatattctttcttgttgacagagatagcaacctaataggatagttttctctttttaggagctaaaattttatttctgtgtaattatccttgtaagagatttgacaagacctcactaaaggtatgaatgtcctgttccagcaggttctagtcaggaacatggaaagcaaatcagaaatttcaaatagaggggatttagtatagggaatagaccgcatgtattttagaaagttgatgtagcaaacgggatgttgaggtaatccagacatcagtaactgcaggaagtggctgcttctgtcagacagggagaaaaaggagagaaaggtggtgttatgagaacttacacaagtgcaaaggagaaaccctgcatggctgagcctcatacttctggaaggttcctgtgtcttgtgactggtgcttcagcctctgagtgggggcaccctgtggccaggcttagacatcttaaagagtgctcaaagactggaactcaggcctcagggagggcaaatgcttgccagtgctaagaattcggagatgggaactgaaaacttgagttcagacttggtgagccgctcgtgttggtctctaatgaggaatcctgtggcaggtgctgggagtgcgtaaggaagctaaagaacggaaccatagctttcttttcctctggaagcatctaacagggtctgaaataggaagagagtcctcttcatcctgccagcttctagtctcctgtcaatgtcccctgttgcagggctcgaatgggaagtgggctggcaaggagtctgggaagtgtagttttcagaatctcagcttcggtgtcactgagcgtggatgggggtgggaaactttgaggctgagagacactgggtaaataacagacatatgctcttccaggaaaaaaaaaaaaaaaagtagacttggcctccaaggccatgtgatgaaatacagtctccttgttttgtaacctgtttccaacatgattcccaataactctcgagtaagaaattacagcttgggataggacttctgtggaaaaaccctggtgccagtgtaaaaagtgcctccaaagtcaaagcattcctgttagtcccgacacatagagcccatgatttattgtaatttttacttaattctgcctccttctgtaggccctggttccaagaacgtcttttgggcccgatgcctccatggctcagatacttgggaacagcaatttgccataatgtctgctgctcctcaggcctccctgccaaccccctggctgtgtgcagccagccacaccctattcctccagattgcattgctccatgtgttttttcttccttggaaacagaatgccatgtcttaacctatcccatcagcagactctatttctttttttcttcatttttcactactttttgctcatcccttaattctgatgcttggcctatgtccctggattttttttttttttaataacgataatgctcttttcctagaatcttactatataaagagcatcttgtaataacagtgacagtgaaattttttggctccacgaagctttagattactcaagagcttttaaaaatctacaacttcactgattcaatattggggggaaacaggtcatttggattcaattaatgatatttaaatcctgaatctaatttaattagaccacctttatctacttaattcctctgagccttagtttcctctactttaatagagggctaagacctacctctgaagattgctaggaggattaacataagctctgtgctacatctggcacatagtaggacagaataatcttagttctctttcttcaagtgagagtgggtgtggtgctcttatgcatatggagaaaggaggccatataaatctgtcctgagctgtataatggatttcacaataagaacaatgagaaatatctgagcaatgctatttggaggataatttttttttctctgttcctatagaaaaatgggagtgatattatcatcagatgaatttcaattatggactgacttccccaatgtaactttacccctgtacttatctattatttttgtatgtgtgagagagaaaattcggaacaaaagcaccagactgggacaatatggggctgttcctagggagagaatggtggattgtaagacttgaaagttagtcttgtgtcagactatgcagattcctgaatgcctggctaagtagtttccattttatttcttaggcaatagaaagttgaaaccaaaaagggtaaaataaataaatgaataaataaataaagaaccttgtaaaatgaatttgacattttatataatagctcttacttgaggaatgacaggtaacaagattcagaaaaatgtaagatccaaggagattcatctttggtgagaccttttttttctttaaaggactttaggaaagacatacttaaagtaagtgctagtagatgaggtgttcctttcattttattttccattttttcattcacataaatcatgacttgtcattgtttgcttcaaacacaggagagattttacctgtgggtttattctgttagaatttgtctatttgttgtagagcaggatcattgctgcatttgctaacattctgggtgaggagaaagatgcataaagagatcagggtaaccaacatggtaagcctaatgacaaccacaggcagatatgagtccctcaaggggggaatttagggcttcaggaaaagctttctgaaaacatgcacacaacaacagaaaaagatgagcgagccaagtcttagggaatgaggagtcatcatccatgtggaggaagaacagagggcaccacaatccacatggaggaacaatctgagcaagtgcacagagataagacacaccacactacctgaggacactacaagcaatttgtgattctggagggtagcaaagcagagagagtgaggagagaggagctgaggagtaaggcaggaccaggaggaagaagttcttgtgtgctcagccaagaaggttacactttatcctgccagtgatgtggagatgttaaaggtctctgagcaggtgagtgacactgtagaatttgttttattctgttctggtggctgcataaaagaaggaaaaagatgataggagagagaccagattggaggcattgacaataacctatgtaggcatgggaggcaaggactactgggggccaccatggagtatgaaactagggtctgtgggagttgatgactgagtgaaacagggaggtaagacatactgaatgacgatgagtctggccatgatgactggtgaacgaggttaccaacaccaaaacaaggaacacaaaaggaggttccatttggggagaaagacaatatgttaggcttaggaaaggatgggtttgaggtgccttgagaatgtagaaaactatactcctaaatcaacaggcagtaattggtagaccttgggtaactcattttatcctctgagcctcaatggactcatccttttagaaggacacaataatatctagtttccagggaaagatcaatttgcccagtgaactcaaagggttgcttttatcaaactcttttcattagcaccatctttacattaatttataaggaagaaacaaacaaacttctctttctaaaattgaccacttctcccttctgagccaaggatgctctgttagtcatcttaagcttcagaagtttttctaccctttaggactggcctttgagctttatatgtgtccatgtgtaatattctttctgtttagtcttcatatcaaggtgacaggttacagcatgaaggtcctggggtggatatatcctttttgagaatacatatcaacaaattcaaaagtctggagaagtaaaggtgattcagaaagtattttgaaatttgtgaaagttttccaaataatcttcatatttatttatcccatatcatatttccaaaagttgtaaaatgaattttactgttaaatattttgtccttcttttccaaaataatgataaatagctttctcatctctgtaaaagccatctattttggactcaaagcttccttggactcaaagtttcctttttatttattttttcagtggcaggacatgaaggggacagagcgaaaaccctcagcccacatttactactagtaagccatgaaataaacaagtcctgaccatccttaccacatgttttcttggaacaaaagggatgtgggtatgacagatccaacttttgctatgaactgtgaactagcatatttttaacttggcttctgaggttggtgaaggaaactttcttgtcctttgctaataaaatgcagatggttcttcttccaaagttcctaaatccccaaagtctgaatctcatcttcttcaaggataagaatagatttgtaattcagtaagcctcaatgggcatcatcaccattcttccttccagatagctttttaaagtgcttgacatataataagtattcactaaatatgtattgaatgagtatataagaagacattgccaggcgcggtgggtcacgcctgtaatctcagcactttgggaggccgaggtggatggatcatgaggtcaggagctcaagaccaccctggccaacacagtgaaaccccatttctactaaaaatacaaaaaattagctgggcgtggtggcaggcgactgtaatcccaactactcaggaggctgtggcaggagaatcacttgaacctgaagcagggcggaggttgcagtgagcggagatcacgctacagcactccagcctgggcgacagtgtgagactcggtctcaacaagaaacaaaacaaacaaacaaaaaaagccacattatcagtaagcttagagtctgagctcttagtgtaaatcctggcattgcaggccattatcaagaatgggagaaattactgggcaccatattagaagaaagaccttgaagtcagttaggtcaggattaggatcctggttccacctgtcctaggcacatgtagggaggagttgggtcaaaaaacatagctgctctgagactccatatggtgtagtggttaaacatcagggcttttaatttgaatactggttctgtcataaattatctagaggaccttgggccatttactcaaacgtctttgttttttgacctttaagtggagagaataattgtacctattgttataagtttgctgtgaggatttatgagttaatatacacaaagcacttcagtagagcatgggacacagtaaggactttgtatgagttaactattattctgttatttttattctactacctcgtgctactacagagtgctactctgtgagaatgtacacttcttttcctatggacaggttccatagttttcaacatcatgatagtggtattgaggcagtcatttaacctcagccacttcgggttttagttttcagacatgccaatgagacaatgcttcctatccctgctggatagataaagcataggctttttgtgaggcgcaaataagattgcaaatgtgaaaacacttagctgactctcaaatgctctataaatgtgagtttattagttggaactctttctactacaagtgacaaaaattcaactcaaatcagcttatgccaaaaaaataatttattggttcttgcagctggattctagggtagctcaaagacttgaaggaagaactttaagaactaggacattgggaacccaaattgatggccattgtaactggaatacacagtttatacctatctgttatctctgatggctgcattctcctctacacagccctctttgcacgtaatgaggaagatagcaccagaaacctcgcttcatattactttaggattccaagccagcaatatatatatatagcaatatatatatatagcaatatatatatatatatatagcaatatatatatatatgattaatttaatctcccttctaaccttggattgattgttgggtacatattaaatggaaaggattgtggcccaacttttttagcccttggtcacaactctttccatttaatatgcaaagaggaatatattaccagaagaagaaataaagaggaaaaaaggtactgggaagattttttttaaaaattactctcatagattatcactactaacattggtttctttaacttctgtagagatgactacaatgaacctctctgtgtaagtgaaagactagattaaatatactccaagcccttgagtgttttcaaatttctggccgagacaggttatcaaaatattgatcccattagaagttgtctttgtaaaagaggaatcctacccacagagtggtcttaacctttgaactattgaccttttgggctggaaagttctttgttgtggaggactgtcctgcacatcctaggatatttacagcattcctggcctgaagatgccagtagtaacttctccctctctatgataacccaaaatgtttttaaacattgacaatatcccctaagggacacgccttcccacccctgcctttgagaataattgtactagtggaacacagctaagcagtaattcatacttctctattctccactcttattccaaaatgatgggtgtaatgctggccagctagactggttttataactttttaaccttcctttgttccctctctacacatttcattacactgaactaccccaccaatggacatttgaaaggtcatattgttgaaaaagactgcagggcacgtgactcaggatattttgggtactagtccttcttctgccactgacttggggtgtgtagctgggcatctctttcctctctgggccttggatttccatattggcaaaaactgaaagatgtcctgtaatttttcgtgttactctagcatttatgatacaattggatgagatatgaactatgaaatgggaaatcaccctacatatttcattagttgaatagtttgtgattaagagtctaagtttctcacaagcatctcttttgtttcttggaagttaagatcgcacctggttgcttgggatgtacagggagtctgggcaaaagcaaggataggtgtattagtctcttatcatgctgctaataaagacatacttaagactgggtaatttataaaggaaaggaggtttaattgactcacagttcagcatggctgggaggcctcaggaaacttacaatcatggctgaaggggaagcaaacacatccttcttcacatggtggcaggaagagaagtgagtgagtaaaagggagaaaagccccttataaccccatcagaccttgtgagaactcattatcatgagaatgtcatggagggtaaccacctccatgataaaattaccttctattggttccttccatgacatgtggagattatggaaactacaattcaagatgagatttgggtggggacacagccaaacaatatcaatgtgcttatagcagggtctttgctgctacttgatgttttgtctctgaagattccatctgtggctagaaaaaacagtatgaagtggaaaaccattcactgatactgaagcataatgtatgaggggctggaatagtaagaaatacagtagaggactgtgcagggccttggatgccagggtaatggacacaacactgatacccaaagaggggggtaaggtagaatgcataatggaacaaatatccatgtaactgggtgaattatttctcatctttatgtttaaagttcagaaagatggtagagtagaattagccagatgcattttggagtagataatagtttgctgcctctttatttttcccatcaaaattaaatggcttccaatattcacataattgagaaaactgaggctcaaaaaggaggagtttacaactccacagtgatcacattgtgagttagtggcagagtggagacagccagccaggcctcagaacaccctcctcttgccttatataattcaataaaaggagacacattgatgctggtttttccatcttgctttcctatacctccccattcttgggagggtttttcactaagatttcagtattattgttgccatttactcctagctagaggcatcagaactaataaggtctagaacagagttcatggagcaaatgtctcctctctacttggctgaaaaaaaaaacaaaaggaaaggaatgaagatgtcagttgtgttttcagaatgagctttccagcagatggagatgggaacctatatatatttttctaacactatcttctagtttctagttcctgtattagtttccagtgcccaccataacaaattactacaaatttcatggcttaaaacaagagaaatttattatctcaggtcctggaggccagaagtgtgaaattactgttccttgtctctcccagcttccagtggttcccaggtgttccttggctttggccagatcattccaatctatacctctatggtcatccttcctcctttttttctctgtgtgccttttataaagacacttgtcactgtattaagcgtccagtcagataatctagaatgatctcttaatcttgacagcttcaatttaattacatctgcaaagaaccttccccaaataaggtaacaatcacagattttgagtattaggacatagatatatgcttctggacaccaccatttaatccactacacacaggaactgtatgtacagtgtctcatcagctcctcacaagtctgtgagttgtggatatatataagcattggcttttgttgttaaattcattttaggatgaaaacatgcagaaaagaagggtttttttttttttttttttttgagacagagttttcctctgtcacccaggctggagtgtaatggcttgatctcagctcactgcaacctccacctccctggatcaagtgattctcctgactcagcttcccaagtagctgaaattacaggtgcccaccaccccacccagctaatttttgtattttagtagagatgacatttcacaatgttgaccaggctggtctccaactctcggcctcctaggaggccctatctttagaggacatatatacagatacactatgttgaataggggattcccattagggtattgagtttgacccaattattattctcttaacggtttaaaggaaccttgactcaactctgaccccgtctctatttagctgtgaataatttttaatgagtctgtttgcctcttgctcctcagattttccaagtgtgaaacgagcaatctgaactatgagctctcacttagtttatgagtcaaaccttccatcaaaatcagtcctgaagaccaaggttttgaaggaataatgccatctttacaagtgtaacttttgctgaaaatattcaaactcttcccactacgactcaactagtgatacaaaatccaattgctaggaagctttaggattcaccctggtgaggaccatcttccctgaaatactcttttcttctaggctatacctcttatttcaccttcaaaacccatcttaagtattcctccttccctgatcttcctaggcaaaattcactaatcttaccatcccctttcccctcccctcaatactttatgttgtgcatgcttgaatagtgacacttatctttatatataattattcctttttcttatctcactcttctaaagtgtgagtaaatgcatgaggtactcttaatattctttgagaagatgtcaagatgaggaacctacactctcacttttcttcttgatagttgattggaagagtgccagagctgttagaggaagaaagtctgagttagtgaaatacagaagacattttttaaaagaagtctagtgctgtttttcctttgtgaaagaaattgcttctttgtttttttcctcttgtctttgctttccctcatccttttctttctgttttttaccgtttattttcatcctctatcaaacatgcatgctgagctctaactaatttgcagttactcctacgcctaaagataaagagataaataagccactgtcctgccatcgaatagctcatagtctcatggccaagatagttgaggaaataattacagcacatcatactatatcatatcatttcatatatgacatatatactagttaacatggtacaatcattgtattacatatttttacatataattttaatctataatatgtaccatattatacactacaaggaggatgtgccaatgctttagcagtcctcctcctggctttaggagaagccatatagaaaatgtgttagaaaatgaatgtcttcatcagacaaaaaaaggaaatttagaatggagcacactcaaaatctcagagactgtgaacttgaaaagcaaacccaggcagatatatgataatcaaataaaattttctatgtccacttttttcatggaagagctatttttaaggcttacttgggggttccagttcccacggtagatgttgtacctccactagctctgcaagacagtgggctgtgccaacatcatcatctgcctaccattcagatctccatccaaagcagacagcaggatactagcaagctgagactgagcatatcacccttctccctgaacactcagcctagtttgcattagtccccttctctgctacttcagactccacagaaaccatgtgtctttccattgcaaagttaatttgcaaaacactcaataaacttctaattttattttattttcctgggatctgatgttgcaaataaaagaaaattataaaatgggggcaattactgattgggctgttattgattactgtgttattttaataccaccaatagccattaattatcaggtcataaaggtacaaagcataagctgatttatcataatatccctgtatctttgactgtgcttggcataaattaggtaaccagtaaatgagaattaaattcagttgagcaagtttgaaggattaaatgaagcaggcattattcattttctttatatatcagaaatggatcagaatttaaccaagaagggagctgacattccccttgtggtgtgctagttagtccaggagctatttcttatggtacgaaacacacatactctcctgttggggtgtttctgtggctgacttgatggaggtctgcgtgcatgacctttctcttttcagccctcctctcctgcattgcatcttacttcatgctactgactataaaatctttctgaaatgcagattagatcacctgtccaagattctgtttattttcataccatttgtgatggttaatactgagtgtcaacttgattggattgaaggatgtaaagtattgttgctgggggggtgtctgtgagggtgttgacaaaggagattaacatttgagtcagtagggtgggaaaggcagacccatccttaatctgggtgggtaccatctaattagctgccagcatggctagaatataaagcaggcagaaaaatgtgaaaagactggcctggcctagcctcccagcctacatctttctcccatgctgtatgcttcctgttctcaaacactggacttcacgttcttcagctttggggcttggactggcttccttgctcctcagcttgcagacagacggcctattgtgggaccttgtaatcgtgtgagttaatgctacttaataaactcccatatatataggatatatatatatatataaaatagaatatatatatatcctattatatatagatatatatataaaatgggatatatgtatataggatatatgtgtatatcctatatatatatacataaatatatcctattagtctgtccctctagaggaccctgactaatacacgatttaagaaaattgtagtgagaacacttaacatgagatctatccttatacgaaatctttaagtgcacagtacagtattgttaattataggcataatgtttacagcagatatctagaacatttgtcttacatagctgaaagcctatactcactgaacacaactcatttctcctctctggcccctcacagccaccatttggttgtctgtttctatgagttttactattttagatctctcacagaattagaatcatgcagtatttgtccatttgtgactggattattttacttagcttcagtgactggattattttacttggctttacagagtttattcatgttattgtatatggcaggatttatttctttttttaaggctgaataatattccggtgtgtgtgtgtgtgtgtatgcaaatatacgtatttttaaggctgaatatttcattgtgtctgtgaacacacacacacatacacatatatagacatttaggctatttcttggctactgaataatggcttgaataacatatattagcttgaataaatgctgcaatagatatggaagtgtatatatttctttcagatcttaattttaattcttttggatatatacctagaagtgagagggctaggccacatagtaattccatgtttaattttttgagggaacttcacactattttccacagcaactgcaccatttttacattcccaacagtgtacaagggttccaatttctctatattcttgccaacatttatcttttttctgataatagacattctaatagttgatattttattgtacttttgattgcattctctgatgattaatgatagtgagcatgttttcatatacctattggccatttgtatgtcatctttggagaaatgtctactcaagtcctttgcccatttttaaatcgttatttatttatttattttgctattgagttgtttgagtttcttacatatcttagatataaataccttgtcagatctttggtttgcaaatattttctcccattctgtatgttgcctttttactctgttgattgtttctttcgctgtgcagaagattttagttcagtctcacttgtttgattttgcttttgttgcttgcgcttttgatgtcacgtccaaaaaattattgccaagtccaaggtcatgaagcttttccccttcatgttttcttttaggcattttatggctccaggtcttaggtttcaatctttaatgcatgtttagttgattttatggtctcacttctgcctgggcctaagccccacccctcagacataagcatactctacacctgcatggctgggcagccctcaaatatgccttgggttttctcgatccttcatggctgcacatgtaccgtgttccaggaagatacctgttcaccatttctccatttgtttgacttttttttttttaaagcccatctcagacctgactacctcatggaggctttccctgaaagcccatggcttgattagggaatcactcttccttttttcatagcctgtgttttctctattggtcatgtgtgtgctgttttcttcaattcaactctgagttccatgaggataaagataatgtccttgttcttggtaacattctcatttctaatcataggacctagcatctactagttgctcaattcataggaaggaaggaagaaggaaggaaggaaagaagaaaggagaaaggaagaaggaaggaaggaaagaagaaaggagaaaggaggaaaggaaggaagagagaacatagagggacagttatcaccaaatggcagcagaagaccatttggtgatatgaccatcctagaggaaaaaaagtgggcacagggattgctacactctgaatgtttgtgtccccctaaaattgatatgttgaaagctaatccccagtgtgatggtatttggaagtggggcttctgggaggcgattagatcattaaggtggagccctcataaatgagattaatgtcctttttcatggtgatatggttaagttcagcaagaattattttatgtataagctcttcagaaagaatttgcaacagctgcccactatctggctttggaggatcaaggatgtgtggctactcagctactccataaacattctagggagctaaagaggaatttgctgttcaccctggaagccagtgggttgcttttgtttgttgtgtctctgctgccatgactcccagatgacaccccatctacataaatgttgcagcaaacagagatggagccaccaggtggattttttcaaccccaagaacctcagcaaaccagcagctgacaatgactgagagtgggccccaaacacaggggaaggaatgtggatctgtctcgatctgcctcatgtgaggggaaatgataaagaaggagtcataacagactggcagcaactcaagtatttggcactaaaggcctcttccaaagaatcattttcaaagatgggtctgcacccctgcagaagttctcatgtttctataaatgctatgcttgtctttctttcttttttctttatctttctttctttttctcttttaaaaaattttctggtctttcagtgtaaagaattagaagggccaggtctcaggcatcaggtaaagactggaaaaaaatatataaggatgtgaagcaagcacccctttggagaaacagcaggtctgtctggaaggtgtccttctgccctcagggaccttctctttatgccagcaatgccaggcccactgagttcttcccacttaccttggtgttgacccgatgcctgaattccccatcactttttccaaatggctttccatctcttctcttctcttgactataccctggggaaaagatgctctttgggcttctctttctactttataaagtaattccctgctgacaacagagtataaccatacattcttgcctgactttccttcaaagtcatgtctaccttcctctcatgctcttgactttttattcattaatttcctcatttcttctgtgtctgtctccacctgttccctggatcttcagcttgcagggatccccttgtttatcacaattaaggtatacattggcttaaaaccctattctacagatggtgggatctcaatgtcctataatgttctatgaggactccagggattccggccctggttcaggtctctcttattctccatctcttcacttctcccactgccattcatcaatgattggcaaacatttccttttaatttattttccccaaactcaaagataataattgtggatagcagacttttactgacaatccaacatcagagtatgcatgtaaaagtgtgcaactttacagctgatcatggaaattatttcagctcagcctgcattcttactatttctcttcctccttctctcttttctagtactttaaacctccttctccaatattgtggtttatttcctgggtaaaactgtttaactgttttatcctagccctcgccagtgccacttttaaataacaaaataacccatgagagatttttgctacttaaaggccattctctcccttaagtacagtttaatcactagatattagtctaacagctttctgtactatacatttgctcagtcgacaaatggccttagtgactatggatgtgaaaaaggaaagattcccacttttctcctgtagttcgatgctttacattatagcttctttcaagtcttgagagcaggtgccacatttcatttgtttttatattgctggtgcctagtatcatacctagtatgcattgacaatatgcagtaaatgttttatggcaaagtggtttcaggtattgtcattaggcacctttaagaggtgggaagatgagactcagaaaacttatgtcgtgaagtcttaatcatagagtaaatggcagagataggtctggaaacacccaaatgttcagacaccaaatatcaaactttttcttctctatcatattagtggcatgtttcccatgaataataatttattttttcagattttacacatatgcaaaattgttcctttcaggctgattacccatccctacaggttcatcccccactgcatttgtgtgagaatgggtggtgggcaattgttgagggagggcacatgcagagcccattcttggccctcactcaggtaccaggtgctccagccatcgttacagctgactgctgaagaagctactgtaagtcagttcaaagagtttctgggctcttttttacacagtcagtccttgaaggcacaaactgggccatagcagcagaaaatgaccatcctaaaggaaaaacaaatgggcacaagggattgctacagtctgaatgtctgtgtcctcctaaaatttgtatgttgaaacctaatccccaatgtgatggtatttggaagtggggcgtctgggaagtgactagatcattaaggtggagcccttataaaagggattagtgcccttataaaagagatcccaaagaacttcttcatccccactactatgtgaggactcagggagaaattgttatttctaggaaccagaaagtgggttctcaccaaacaccaaatcttctggcaccttgatcttgaacttgccagcctccagaactgtaataaataaatttctattgtttataagctaccttgtttatggtattttgttaagcaacccaaactgagacaataatgttgcccagtatatcagttttctattgttatgttacaaatcaccacaaatttaacagctaacatataacacaattatctcatagtttctgtggattagaagtgtaagcaaagacttagttagttctctgcttaaggtctagatcttaagccaacagctttttgcaccatacatttactcagtaaacaaaaactgactacccttgagtatgatatcctaggccctactgactatagaggtgcaaaaggaaagattcccactctgcaatcaaagtgtcggctgggctgtgttttcatctgaaagtttgactggagaagaatcaatgtccaaccccattcaggttgttagcagtattcctttctttgtggctgttcagctgagggttttagcattgtggcagctatcagtatatttaaatttcttctttctggattattttaacttccatttcaatgaaaacaatataaaaatattccttaagtataagtagtaaaaattactcaaaaatcatatgggcattaattttgaagtaggtattttactatgaaattcaatctgaataagaatgttggaaatctttcctgtggaaataatgatcaaaatagtatcaagatgaattgatattttttttctttagcatacgaacccataaattgaactgaattcaggagaattgcttgggcttaattagaaaatcccaggtcttcagtaagtgctactttatgacttcatgtacttccctaacaatacccttctctcctctcctgtaacccctatgtcttctctttcccccatttatgggacttctactgctctgtatcattcaccaaatctcttgtatggcctgaattaattatttgagaagtcctgaagacttggttggggactaggtcccaaatattccaactcctaaaggctcaattcagctcaaagcatgcttacttggaattgggtatatcagaattccagaaacttaatgtaatttttaagatgaaaaggctgtatttaaatagttgtaaatagtttgctcttttctggagtagagatgtggacttgctttaggaggagcagactgtgccttttgcttctgtttgcagagggacttcattgtaggctcttgcagtcatctaggtcatgagtcaacaaactttctataaaggaccagatagaaaatatgttatgttaggctttgcagtccaggtggtctctgtcacaactactcagcacttcattatagcatgaaagtagacctagacaatatgtaaaccaaaaagcatggctgttattacaacaaaactttatggacactgccatttgaattttatatgattttcataggtcatgaaattttattatttttttgacctttgttcaatgattgaaaaatgcttaaacttttcttggcttgcagaccataaaaaatcaggcagcaggctggatttagtccctggggtatagttagtcaacttctgttataaatacaaagcaagcacctaccccttgttttttgggaaaaaaaaaaaaagtctctcccccatcccgttggaagtcatttagggctgcattcagagttacagggatctcaggagagctggggagaagagaactgtctctgaggttgggctttcaaaataactgcttgctatatttggaggcagcagccaaaagaagagccttatagactcccagcccattgcagccacgtggaggacagctgggcccagccaatctaggattgcagtgatctcatgggcaggtgagggggctgtacaggaagattacgaagggtaacagctgccacttgagtgaaatcatctcagtagagcaaggggcgacctgtagaagaacagatggctgtctggagatacatgcctggtttatacaaaaggcgacaaccaagagagagttgtggaaaattttaaagtgtcatgaagattcccagggatattttgtgaagtgtggtgcagcactggtaaaagaatgaattttcattgagtagcttgaggaataatgcacctataatttggacgcccaaagaagtgtagggtctgacttctgaggtctgagatgtatgttatcataaacacttttggtttccaagcaacatctgtatctctattcttcattctgtttttttttttttaactttctactttgaaaaaatttaaactcttcagaaaagttgaaaaataatccaaaaacctcccatattcccttcatccagattcctcaattgttaacaattttccacttctttttctagcattctctctgttttgtacatacccaactgcacatatactattttttctgagccatttgcaaataagttacatcagtttatagttcttaaaaacaaggatattctcctgcataacgccagtacaaccatcaaaatcaggaagttagcattgacccaataatgctgcctgatgcatacatccagttgaaatttctgttgtccccataatgtcctttatatgtcttggatccattccagtaacgtgttgatttagttgccatgtctttttactctcttttagtctgaaagaattctttagtctttccttttctttcatgactgacatttttaaacagagcagaattgttactttgttaaatgtttctcagtataggtttgtataatgattcttcaagatctatgagctttttatagaaatattagccaaatattcttctcatggcatcatattgttaagtaccaaatgctaatttgtaccattactggagatattaacttttatcacttggttaaaaggtgtctataaggtttctctactatgaggttagctaataggtattttgtactcatcaattaatgattaataagattgcattttgtgggtaaattcatgtcttctactgtaagttggagcttttccttctatcctatgtatttatactggtatagatgaatggatttcttttttaactcaatggattatagcctgtaaatatcgttcctcattttgatactcaaattgttctagacttgaccagtggtgcctttcaaactggctccagtggcgtctccacctgttaccatcattcattcagcaattccttggtttatcatacaacagaacattccaggtgtcttgtattagtctgttctcgcacttctataaagaaatacccgagactgggtaattgataaagaaacgaggtttaattggctcccagttctgcaggctgtacaggaagcatgaggctggcatttgctcaggaagtgtataatcatggtagaaggcaaacggggagccagcacttcatatggccggagcaggaggaagagaagcagggaggtgctacacacgtttgaaccaccagatatcgtgagaactctgtcactatacagtaccaagaggggatggtgctaaaccattgataagaactctaccccatgatccaatcacctcccaccaggctgcacctccaacagtggggatacaattgaacatgagatttgggtggggacacagatccaaaccatatcacttatcttgataagtgactttcctttcttcagctctggaaccatcaatactctttagttgttcctctactttatgtaatctttattttatgtattattttacatattactttatgtaatatgtaaaattattttacattttacattattttacatattactttatgtaatcattattttagtagagaagcatatacagaaagcaagaaccaagactgcccattgggtgaggggtgccagtgtttctaggtacttttaataagcagatctagaacacccacacacagagcacatacagacacacacacacaggcatacagttacagacacagatacacagacacatacacagacaggcagagaacacacagacaggcagagcacacatagacacatatacagacatacatagatacagacacacacacagacccacagacccacaaacatgcacagacacacacacaggcacagacacatacaaacatacacacagatgtacacatacacagacacacagatacacacacctgagccagaactgtagcattgaatcaaagatagagcctgttctatcttttgaccctcaattatttgtatcagtacattttctttttaatgaagccaatttgaatggggttttctgttatttgctgatgaaagcaacctaactgataaacacagataatggttatatgcaccaggctcagttctcagaagctggaatacagagataaataagcctaatgagatcaaattaaatattataataaattctatgataaggaagacacaagacacagtataagctcagaggaagtctgcgtgaggtattgcctaaactagccagaagtttgctatacatagacatcacagaagaaggagaagccattatagacaaagaattcggtgcaaagacttggaatgccaaaagctgaaggagggtggtgatagaggtgttcatgtttgaataaaaagtatgagtcgttaatttaataatgatacatatgttggtcatatatgggtgctgtaaagatatctctgctgactgtatggggataaatatgtccagaggttatggggaattgagataaaaggctaaattcttccagggcaggaggaattcaaagttataaattcattcctctgaaatgcctcttcttgtgagaatggattgtggtgtgcgccctacttctctgaagagtatgctgagtttgattcatgaacctgaataattttcttaattttactgacaacactgtgtattggacatgatagcagaggccaggaagctgtctgtctcaagacctgaggctgtttactcctttaatccaagatggcagatatgcctacacatgagttctcttcaactaagtcgtagaacacaatctcctgggccaaaactcaatcattctctgaaatagcatctctgctctgtggattctttctgccactccagaattggtctcttcccagtgacacagatctggtgcagttttgatatgatgttggcagttgcaacttttgggaaaaggcaataagaatctgtctgcttagtgatctccataaaaacctagagcaccagtcatgtcactatattgcttaactaattttaaagaaaatttagcttgtatcattttaattaaaatccaacaagaggacaagacccaataaaagaaagaaaaggggcaaattttggaaagaaaggcataatcattattttaggttataagatatatctacaaaatcagaaagaactaacaaaaataatattgaaatagagaaggcaatttagaaagtagtctacatacaagataagtagagtaagaaccaattaagtatcagcattaagaagatagaacatttaataatatactgtacatcaaaaaacaaaataaaattattgatgaagagatataaactgtccagcaaccttaccttccttcagacaaccaaatgtcattgtcaactgaactgaattgagcatgaaggctaacaattatttagcatacactgtaactctttttgttgccaagtactcttagaacttgtaccatgattctcccaggaatccttatggtatatactacaagccctgctatggcttgaatgtgtcttccaaagttggaatttaatctccaagttgttgtaaacttaatctccaatgcaacagtgttgggaggtgcagcctactaagaggtggttaggatatgaggtctctggcttcgtgaatagattgattttatcattgcagcagtgagtttgttatggtcccagtaggttgttgtgaaagtgagtccagcccctttttactttctcactctcttgcaagctcttaccatttcaccttccaccatgagataatgtaccaaaaaggccctcaccagatactggaccctcaaatatggacatcccagcctccagaaataggagaaataaatggattttctttataaaatatacagtctgtgatattctgttatagcaacaaaaactggactaagacaagtcccattccgcatataagaaaattgagacacaagagagtctcgagatcatacagctagtaaatggcagcatggaattaaaatcctgtctgcttaactcaaaattcatagtatttttttataataacatgctctagattgagttttcagttgtcaaattatctccttaagtgaaagttgttctttttttatgagaaaacacaaactgctatcttccaccctggctcttttatatttgtaggtcaacattttttatatttggcttccatgcagttttctctctagtcccacaggtgaaacactccaatccatagtcagtactctatatctagtttgatttagaatagctgatacttgtagcccgggtgtggtggctgatgcctgtaatcccagcaatttgggaggccaaggtgtgtggattacttgaagtcaggagttcgagaccagcctggccaatatagtaaaaccccatttctactaaaaacacaaaaaattagccaggtatggtggtgcacagctgcaatctcagctactcgggaggctgaggcactcgggaggctgaggcacaagaattgcttgaacctgggaggtggaggttgtagtgagcctagatcaggtcattgcacttcagcctgggtgacagagcaagactctgtctcaaaaagaaaaaaaaagaatagatgatacattagatgatacatgtatagcgaaaacaaaaatgtagcaatattattttaaaattagttcctttgttttaaaagttaaatgtagagaatttgtggcattttgtcttggttgttcaaattaaaacttgaaagagacggaggaggaattgtggaggtcctgttgattggattaaatgtccttactagagtgaagttctcatagagcattccccagctgtgactttccaaatgttacggccttattaatcaatgtcatcttccatatcaaaagtccaaatgcttccttcctgctttgtattaaaattttctccagggattggatctttccattatccttccttctgaagaatgtgtctatgtataactggcaagagaacatgggggagtctttctgaaactttgtggcttctgcctaaaataatttattcaaaatgttttgggaaattattctacagattcttttaaatggagaaataatacaaagtccaaaaattgccttggtttggggataccggcttttaaaaagatctcattattccttcttttggtgattagtatttcgtgcttggtgggttaagaataaatgagctggaaataccgttgttttagtccattttgtgctgctataacaaaatacctgagaaaggataatttataaagtaaaggaattcgtcataattctggaggctgggaagtccaagactgaggggctgcatctggtgagggccatcttattgcatcataacgtgatggaaagcatcacacagtgagtgaactcatgtaagagagaaagggaggtctgaactaacttttataacaaatccattttggtgataatgaacccacttccacaataacaacattaatcccttcatgaaggcagatccttcatgacctgatacctcttagaggtctcaccctgaaacactgttacatttgggctagtttccaacatgcgaattttataggacacattcaaaccatagcaaccattaatgggtatatattggtgaggtttctgatatgaatagcaaatatgatatgtgtattagtccattctcacattgctataaagaactacccgaaactgggtaatttataaaggagagaggtttaattgactcacagttctgcatggctggggaggcctcaggaaacttacaatcatggtggaaggagaagcaaacatgtccttcttcacgtaatggcaggaagaaatgctgagcaaaaggggaaaaatccccttataaaaccatcagatctaataagaagtcactcactatcatgagaaaagcagcatgggggtaaccacccctatgattcaattacctccccaccaggttcctcccacaacatgtagaaattatggaaactgcaattcaacatgagatttgggtgggtacacagccaaaccatatcaatatgatatagtagaaagaacatagggttggaattgcatataactttattcaatatctggatctctcacttatgaaatgtacaaaacagttacatagatgcttttgtttgcaaatgatatatagagtaagaaaaaataatttttccattagatttgctgttcaacacttcacatgcttttatttctcccttgaaggtcttccccttcttatatactcagataatgtttgcttagtcttttaagcttaattcaatatttatttcctctgtgatgacttcaactattcctctcccccaggaagaatgggtattctctctctgactcccagattacttcacactattgtaaatatcacactaaactggaataatttatcttcccagatgtatccctagttagactctgccaagattggtcttcatatccacaatgcccagcctagtgcctgatatcctgtaagtgttcaaaagtgtttgttttgatatactgggcctatataaatagagtcattttcagaataaatttactattgcctgaattttctggataattttgccaattagtcattggtgattgaatcacagagtcaaatgctagaatgccagatctgactcatccaactcatcatttctgttccatctttatagttatcatcatatccacctatcccctccattggtattaatattttcttatgttgagaaaataacataaaaacttaagaacaactgtaaaaactgaattactttacattcattctaagaacttatgtgacatcaagtgtatgagatgataattatcttctagtgcacattacaataatttataactgctgaaatgtttagaagtttgtccatgtagtacccataaacattttacatattgccagtgaaacacagagtgtttcccaaagaaacacttagctttgggtctttcttacttacaagtgaggactttacatgttcagagaaataaatgtctaacctgtggtctcacagctgcagatcctggacaaaaatcttcgtcttcttagctggccttcaatgacagttttatgaattaagccaaatatgtacatttccttggttcctcagcactttgaacagcctttgtcattgcttcaggcttttgagggtagggtgaaagcaagacactacacagctccctgcctgtgccctagcaaccaagcacaacacagatggccagcctggcaatctgcccagcagacactgattgcatacctggtggtaagacacaatggtgtttgcacagtgtggttggcatttatagtgataggcaatgaagactgcatcctgtgccttcaggccagtttgctggtttccagaccagaggcaataactttccactagtgtaatgacaacttgtctcttgcagctggatcatgttaggagagtaggaattttatttttgctcccttttcaatggtgccttgtaataatagggtagtattttcccaatatgtttcttgccagttgtacacatgtattggctcctgaagccctgaacattcattggcatcaaagaatgggaatggtccctatttataggagagcagtccccattctacaggtgaagagaatacaccttataccaatccaagaagcatttattatatgcctgttattatttgttaaattgagtgaatgactattgtgtataagccattctaccaggccttgggcatagaaagatacataacataagcatgactcaagaggcactcagaccagtagatgtgacagacatttaaactaataacatgatgagtggtctaatagaggggtgtacctagcactgtgggaacacaaaggagggggctgttaatccttcctagaggttaaaaatgaaagctaaattgatgctgaacactgcatccagggatatgcattatggcaagttggtgagagctcttgttctgctgcctcacgaatctgtgttcaagttcccactttgctaattactccttttgtagttttaggcaagtctcaaagctttccagatctcattgtatatataatggagacagagttcatgccttatatatgtatataaagtgagaacaaaatgaaatactcattataaagtgcttagcatttttttctggcatctagtatgtgtttaataaatattagctccagttgtcattcttatcattattgttattatgtgatgatgatgtgggttgccttgcaggcagacttatgatgtggtattatcattggcatcagaatatgctggctacagattcacccttgagtttgactacctatgtgtctttgagcagagtcttcactgttctgaagtgatttactttacatgaccaagatggataagtaggccacttatcatcatctcctaagattccttctaaaaacaaatcttttgaacaaggttgggcatttccagaattttggttcttttagaatgtctcattaagctttcagaggcattactcattaggtttcagatataacatgtttttggagaaataacacaatatgatgtggcacattgcattttctggcgtatgagccaaatttggactagttgcacaatctcaagatgcatgtaagactcggaacttgtgttctgatgaagcaggaaaaatggacagatgttgagctaatgtccaggaaatgacaaaagttatgtttgaagaaaatagcttcagacaggggaatgctcacggttaatgggaatccaatgtaatggatgttgtacaggagggagatgtggagtggtggtggtgcacagtgtgctgtggatgcgcagaagtgagttcttcatcctttctggggtgttggaaggtgagtttggcagagccataaaaagatgaatcagagtcaccaagtggagcagatgagaaaggatagcccaggcaaagggaagagaattgcagctacctggaagaattggcatatgtttggggaatggtgagatgcaactagtttggtgtatctggggaaaattgtgtcagaatagactggagaaattgactggagtcagattgcaggaagggatggaaaactactctcagttgagtcccctcatgtgcttctctactcccaccccatcactctctctacataactgaagtggtcagtaatgaatgccaagtatgtgctatgcatcatacaaagtggtttacatatttaatctcttaatcttcacaaaaatggaaaaatttgtgtcttaactagaagcaaatttggctgacagtaatattgtcatttccttgctttcaaataacgaggcataaacaagatataaatttgtttttctcttatgtacaactctggcattcagggttatcctgagggctctggtccaggagagtttttcaggtacataggtgcttctgttttgttgctcttctatcttaattccccaggccatgtcatagcccaaatttggcttctctggttctagatatcttgtttgtattcttgtcagcagcagggaggaagagaagagagtcatgggagcatactaggtgtgttctaagaaagctttctggaagcttcctcacagtgtttttgctagcatcttgtccagaagttagtcaaattgctgcaactagttgcagaagatactagaacatgtaatatttattatgggtagccatgtgctcagctagtaatgggagttctttcactgtggaaaaggggtgaaagaatagttgtatctactaaaggtggatttttatccaattttccagataaagaaattgaggattagagaagcaggataacttgtccttggtggcacagttgatgaatgcctaagatttccactgatgccagttctagtggttctaaccacaggacttgctcttcaacactactcatatgttctagtttggggttcctcccaaaagcagaaccaaagacaagtacctgggtgagaatatttgtaatggaatcataggattaccaacaattctggttttctgacagctgaaggtggtcctgggatgcaggactttcagttttaaaactgaaatgttctggaaaactgtcctgaggatgagatgattcagaaacaagggataagcaccaggccaaaaaaaaaaaaaaaaaaaaaagcatcatgaaggtgcattatgaggcaatgggactccatctcattggggcctctgtgaatcatgcaggatgccctttagaattgttctcctgaaatatgggtacctgaagcatgtacccagtagctcgtttcatcatgagttgagggttcatcccagaggctttgactccagaagcacttctgggtttcgtctgcctgcaccatgagccaacttgggatgagtgaagaaagttctggggcaaaacttagaaagacaaattgcagtcctagatgaggggtcttggccttatcaggtgagtgggaatggtctaccatagggagaactccaattacaggtgagttgagggaataaagtgagtatcagagaaatctgctgcatcttatttaagaactttaaaagctcagatattattttcacagggtagtgatttttaaaccatgcttctttaattctctgaaggttccaagagttttttctggaccaaactttcattctctctctctctctctctctctctctctctctctctctctctctctctctctctgtgtgtgtgtgtgtgtgtgtgtgtgtgtatgtttatattgcaggagtgctcattgttttgactctttaacttaagccagagtggttctaattttatcttttacatcttatcacttgaataaaagtttccacagtttaaaaagtttgtaaagcactggattgagtaataggcagttattgcggcacttatgcaggggaataaattatcaagtaatgcttgaaacatcccattctggctacagcctggggaatgtgtaggaagatcatgcctgcaggcaaagaaaacagcttgaagctgcaatcactcagtcaatgaaggacattggaaaagccagggagagaatggagaacaaagtactaacagcaagacttactctccagcataactcatacatcttagtttgggttgcctccccaagcagagcccaagacaagaacttgggtgagaatatttggaagggaattatagagtaaccaactattcctgcttgctcacaactgaaggaagaatctatatgttagagttcctggactagacaagaaattggatttggatggtagagactgaggaggctcagtctgctgcagagttttgatttgtctagcttaggatcaaaatggtgctatttgttgaaaaattgatacacagtggaagaagctgatttggggagataatgattcatctgtctaatgagtaaatggccggcaactgaggtccttctttctataatatgtggaagcttttatttggggaggattgtgataatttagagaagaccccctggctcctacctcctcttgagaaccctccaagagagaattatccagccagagtgtttgtttttctcagggcgcaggtagaaagaaatcaattcttccttctccgaataaacagatcaaggtatgctgttggtgatgcctgagactcttacctttccattccttaaagaatcactgaacattgaattcattaatggcactttggatataatgtcacatgatgtgaaattggttgtcattaattcatttatacacgggacattcacaaagtaacttggttgacaaaactccctgaaaaagattgacaacttaagaatgatgtggtttcagccttgacgagctctttgtggatttctactcatttggccatttaagactcttcattgtccttcactcatggcaacacactgataaaattagtgaaaaaaataaaacagtaacaacaaacaccaaaaaacctcatcttactaaaatagaataacatccacaatctttaaagcttacttgaaaactatcacacatgaaaggaagaaagaatggatttctcaaaatctgaaccttaggcaggtgtatatggtgaccattttggcttcttaagatataatatgagacataaatgacctgcaatgatgacgggctgctttagaaataccccttcattccttttgctttttttttttttttgagaaagggtctcgctctgtcacccagactggagtgcagtggcacaatcatggctcactgcaggttcaggtgatcctcccacctcagcctcccaagtaactgaaactacgagtgcacgccaacacacccagttaattttttttgtattttttgtagagatggggtttcaccatgttgctcaggctgttgcttaatcctttaaagccatcagctgccccaggattcatccttattctctttttaaataaatgggtattttgggtggaaatttcaagaaatacggaagtatatgaaagcacttttaaattatgtgtgtgttaaaaaaagaatactacatatgaatattataaggatgatgtattataactcgtatcaactgcatacactagcaagtcctgccaaccaagcaactttggagtacaaattgtcttttccttgattagacttaggtctcctggatcttagctgcagggctgctgttcacaaacagagtgctgaaactctcaggttgtttagcacccagctgagggggtagagattttcatacatgagttattctaagatcccccaattgaaaagaatctccctcttaaataccaacataaatagggcaagatgtcatacaagttatatgaaaatgaacgtgatgcaagatatggtccttctccatccctgcaggattcccactttaccccaactgtgccagaatccatggctcagtcttccatccaatgaagcatgctgtatccagactgaggattactgaatgcttattggccctaaaagtactttattcaagtgagatattttgttacaattttatatataaaatgaataggagcagttctgctgaaatgggcatgaggaccctaggacccgtctttcttaggttattcctcaccatgtttggaggcttccagggatctacagaatataacttgcaaatacgtgatgtagataattccagcttttgagtgcctatgggaaagttgactgagttaatcctctgggatttgaatcctggctcaaattttcatgctttttatgtttttggaagacattatttaatttctctatgcctcaaccttctaaacttttaaggaaataacatcttgttcacaaccaaatagagtttctttgaggattacatgatgtaagacatgtaaaagaacttagaattataactgttacagattaagcaccccataaatattacacagtattgttttattaataaggctctaagttaaataattataacttagtttgagaagtcagtccatgtcagtgagcctatgttctcattttttttctggaataaaagtaataaataacaacaaaaacaaaaagaataacatcatcagtaacaaccaccatgaaactcaccaataatcactgctttctagtaattatctactctgtttagccactgttttataatttttctggacctcacagtagccctacagggtaaatgcctcttagacccattttacagatgagaaaatcaagattcataaaaggtaagccacttccccatagtcagacaggtaatccatggcagagccaaagatggttccaaggatgaaggcttcagatcccgatgtctacatacatgaatgatactcaaaagtaagagccaccttttttactgatgctctgtaaactcttttttcggcgaagtatccgtcacatcaatcatttatcgtttctttgtgttacaaatgatctaattatgctcatttagttatttaaaaatgtaaaataaattattgttgagtgtagtcaccctactgtgctatcatatgctagatcttactcactctatctatctaactatatttttgtacccatgaatcatccccactgcctcccaacccaactacctttcctagactctggtaaccagtggtctactctcttatctccataagtacaattgttttaatttttagctcccacaaataagcgagaacatgcagcttatctttctgtccctggtttatttcacttaacacaaagacctacagttccattcatgttgttgcaaagacagaatgtcattcttttttatggcttaagaatattactccactgtgtaaatgtaccctattgtttttatccgttcatctgctgatggacacataggttgtttccaaatagtagctattatgtataatgctgtaataaacatgtgagtgcagataactccttgatacactgattttctttcttttgggtgtatacccagcagtgggattgctaaatcatatggtagttttaactttagtttcctgaggaattttcaaactgttctctatagtggttgtactattttacattcccaccaagaatgtataagggtttctttttccctacatcctcaccagcatttaatattttctgtctttggataaaagcctttttaactgggtgagatgacacctcattgtagttttgatttgcatttctctgttgattaatgatgctgaacctcttttcatacacctgtttgccatttgtatgtcttcttttgagaaacgtctattcagaccttctgcccatttttaatgggcttattagtttttttcctattgagttgtttggggtctttatatattctggttattaattgctggtcagttggatagttgcaaatattttcttccattctatgggttgtctcttcactttgttgattgttttctttcctgtggaggttttttaatttgatgtgatcacatttgtccacttttgctttcgttgtctgtgcttgtagagtattacccaagaaatcttagtttcagatatttggtgcttacatacaaaaatgctactgatttttttacattgattttgtatcctgcaaccttactaaattttatcagttctaatagtttttcagtgaagtctttaggtcttttcaaatacaaggcaatatcatttgcaaccagagattaatttgacttcttccttttcaatttggttgttctttatttcttttgtcagattgctctagctaggacttccagtactatgtcaaataacagtgacaaaaataggcatccttgttatcttccagatctcagaggaaaggctttcagtcttttcccatttagtatgaaactagctgtgggtctgtaatatatggtttttattgtgctgaggtatgttccttctatacccagttttttgaaggtttttattatgaaggaatgttgaattttatcaaattcaaatgccttttcagcagcaatgtaaatgatcgtattttttcttgttaccccttattctgttgatatgatgtaccacattaattgatttgtgtatgttgaaccactcttgcatccttgggatgaatcccacttggtcatgataaatgatattttttaacatgttgttgaatttggttggctagtattttgttaaggatttttgcatcagtgttcaccagggatactggactgtagatttctttttttcatgtgtgtttggttttgatatcagagtaatattggctttgtagagttagtctggaaatatcccctcctctctatttttcagaatagtttgagtaggattggtattggttcttctttaaatctttgatgaaattcagcagtgaagcaattgggtcccaggcttttctttgctgggagaattttcattacagcttcaatctcattacttgttattggtttgttcatcttttgaatttcttcatggttcaatcttggtagcttgtatatgtctaagaatgtatcaatttttttctaggtttttgaatgtcttggcatatagttgctcattgtagcctctaatgatcttttgaatttctgtggtattggttgtaatgtctcctttttcatctctaattttatttatttgggtcttctttctctttttttttttgttagtctgacttaagatttgtcaattttatcttttcaaaaaaacctttttattttattgatcttttgtattgctctcttcatttcaattttatttatttgtgctctgatctttattattaatttttttctactaattgtgggattggtttgctcttacttttatactacttaaagatgcatctgccaaaaggggtggctcatgtctgtaatcccaacacctggggaggctgaggagggcagatcacaaggtcaggagatccagaccatcctggccaatatggtgaaacactctttctactgaaaatacaaaaattagctgggcgtgatgccacacgcctgtagtcccagctactcaggaggctgaggcaggagaatcacttgaacctgggaggcggaggttgcagtgagctgagatcatgccactgcactacagcctggtgacatagcgagactccatctcaaaaaaaaaaaaaatgcataattagtttgttcattgaaagtttttctgcctttttttttttttttttctgaggtggagtctcgtgctctcacccaggctggagtgcagtggtgcgatcttggctcactgcactgcaacctctgcctccgggttcaagtgattcctctgcctcagcctcccaagtagctgggactacaggcatgcaccaccatgcccggctaatttttatatttttagtacagatgcagtttcaccatgttggtcaggattgtctcgaactcctgacctcgtgatctgcctgcctcggcctcccaaagtgctgagattacaggcatgacccatggtgcctggcctatatttttgatgtagacaattatactataaacttttctctgagtattgctttgactgtactccataggttttggtatgttgtatttccgttatcatttgtttaaaaaatattttcaatttcttttctaatttcttcattcacccaccggtcattctggagcatattttttaatttccatgtgtttctataatttacaaattttctcttgttattcatttctaattttattccattatggtcagagaagatacttgatataatttctttttttaaattttttaaggcttgttttgtggcctgatgtatggcctactgttgagaataatccatgtgctgagaagaagaatgtgtattctgcagccattagaagaaatgttccgtaaatatgttttaggtctatttttggtctatagtgcagactaagtctaattttttttttttttttggggggggtggatggagtctcgctctgtcacccagggtggagtgcagtggtgcgatctcggctcactgcaagctccgcctcccaggttcacgccattctcctgcctcagcctcccgagtatctgggactacaggcgcctgccaccacgcccagctaattttttgtatttttaggagagacagggtttcaccacgttagccaggatggtctcgatctcctgaccttgtgatcggcccgcctcagcctccaaagtgctgggattataggcctgagccaccacacccgtccaagtctaatgtttttattgattttctgtctggctaatttgtccaatgctgaaactggggtgttgcagtctgcaattcttatggttctgggatctatctctctctttagctctaataacatttgttttataaatcaggatgctccagtgttgggtgcatatatgtttacaattgtcatatcctcttgcttaatcgacccctttatcattatataatgaccttctttttcccttttttatagttgttgtcctgaaatttattttgccttatgtaagtatagctactcctacactttttttggcttctgtttgcatggaatatcttttactattttttaatttttattctatttatgtatgtataggtaaagtgtgttttttgtaggcaatagatcagtaggccttttttttttaatccattcgccttctctttttcttttgattggagagtttagtgcatttacattcaatgttattattgataagtaaggacttaattctgccattttatcatttgttttctggttgttttgttgtcttatcatccttcttttcttcctccctgtcttttagtgaaggtgattttctctgatggtatgttttaatttcttcctttttattttttgtggatctgttgtatttttttatttgaaattaccataaggctagcaaataatatcttaaaacccattattttaaactgatgacaacttaatattgattgaataaacaaactaacaagcaaagagacaattaataaaaacgctacactttaactttgtccccccacttttgaactttttgctgtttctttttgtgccttactgtattgtctatgtcttgaaatgttgttttagttattaattttgatcaattcatctgttagtgtttctacacaagatatgagtagtttacacaacacaattacagtgttacacattttgtgtttttctgtgtatctattattaccagcaagtactgtaccttcagatgattttttgctgttcattaatagctttttctaggccaggcatggtggctcacacctgtaatcccagcactttgggaaattgaggcaggcggatcacgaggtcaggagttcaagatcagcctggccaacatggtgaaagcccatctctactaaaaatacaaaaattagctgggcatggtggcatgttcctgtaatcccagctactcgggaggctgaggcaggagaattgcttgaactgggacccaggaggctgaggttgcagtgagctgagatcacactactgcacaccagcctgggctacagagcaagactctgtctcaaagaaaaaaaaaaaaaggaagctttttcttttcgcctggagaattccctttagtatttcttgtaggtcaggtctggtgttgataaaatccctcagcttttgtttgtctcagaaagcctttatttttccttcatgtttgaagctattttcactggatgatattctggaatacaagtgtggtgctttttttccccacctttagcacttcaaatatgtcatgccactctctcctggcctataagatttccactgaaaaatctgctgccagatatattgcagtttcattgtatgttatttgtttcttttctcttgctgcttatagaatcttttctttatctttgatctttgggagtgtgattattaaatgtcttgaggtagtcttatttgggttaaatatgcttggtgttctatagccctcttgtatttgaatattgatattgttctctaggtctgggaagctttctgttattactcctttgaataaactttctacccctatctctctctctgtactgcctcgttaaggccaataactcttagatttgtcctttcaaggttattttctaaatattgtaggcatgcttcattcttttttattcttgtttcttttgtcttctctgactttatattttcaagtagcctgtcattaagctcacagattctctcttctgcttgatccattctgctgtaaaagactctgatgcattctctaatatgtgaatttcattttccaactgcagaatttctgtttgattcttttcagttatttcaatctctttgctaaatttgcctgatagtattctgaatactttttctgtattatcttgaatttcattgagtttcctcaacgaactattttgaattctctgtctgaaaggttaattatctctatctcttcatgattggtccctggtgttgtatttaatttgtttggtgaggtcatgtttttctggatagtcttcatgcttgtgggtattagtaggtgtctgagcattaaagagttaggtatttatcgtagtctttacagtctaggtttgcttgtacttgttctctctgggaaggttttccaggtattctaagggatttgggtattgtaatctaagcttttggtcactgcagctatgtctgtgttaggggggcaccccaagcccagtaactctgtggctcttacaaacttatagagataccgccttggtggtcttggtaaaggtccagaggaattccctggattaccaggtggaaactcttgttctcttcttgtactttctctcaaacaaatggagtctgtgtctctgtgctgggctgtgtgaagctgggggaagggggatacaagtgcccctgtggccaccaccactggaactgtcctggatcagacccgaagccagcagagcactgtgtctcaaccatggcctatggtaaacactttctggctactgtgtgtattagctcaaggccctagggctctaccatcagcctgtgacaaagccagccaggctgtgtccttcctttcagagcagcaagtttcccccacctctaggctggttcacagatgccatctgggagccacgacctacagtcagaagcattaggaatctacctggtattctattgtggtagagttggcacccagcccacaagacaaagtctttcccactcttccctccccgccacgacctacagtcagaagcattaggaatctacctggtactctattgtggtagagttggcacccagcccacaagacaaagtctttcccactcttccctcccctttctacaagcagaggagttgctcccagtggcaaccgccatcccaggcccgtggcaagtactgcctggccactgctgatgttcactcaagttccaggggctcttcagccagcttgtggtgaatgctggcatgcatgggactctgccttcagggaagtgggctgtcctctgacccagagcacatccagaaaggccatccacgagccaagtcctggaatcaggaaccccaagagccattttagtgctctacccctccgtggccaatttggtaccaaagtgtgggactaagttatcttttttttttttttttttttttcctaaagcagaaggaggctttccttgtagtcaccacagctaggaaatacgctgggtcacacctgaagccagcacatctctgagtcttacttgaggcccacagtgagtactgtctggctactgcagctgattattcagggtccaagagctctttagtaagcaggtgataaattttgctaggactgagtttttcccttcaagcagtgggtgcctttctggcccagggtgtgtctaaaaatttctaggagctatggcctggaatggggacctcaggactctgcctggtgctgtatcaaactgtggctgaactggtatccaagttccaagacaaagtcctttttactcatccctctcttctcctcaagtggaaggcaggggcttcccccagagctgtgagctgagttgcctggggttaggagaggactggagcaagccctcccttggctgccccagctagtgtctcactaggttgcatcccacccactgaccaaaaccacgggctccaagccaagaacagcaccaggacttgcccaggaattttagttgttgtggcttagactgcctttcaagcttatttaggaccccatacccctttagctcatgatagaaaggcttgctggaactcaggttctgatttctggagcgcttgattcctttctcactaggcctggtctaaatgctccctctgtgggtgctggtgctggctgagttctgcctggtattgctttctgctgtgacagggcaacaatgggttccagtgcaaagtcccacaatcactgcactctccctttcctaagcacataggttccctttccatgccacatggccgctgccagggtatgggtgaggggtggtgacagcaattcaagactgtctttcctaccctcttcagtgcctctttcagtgatatcaagttaaaaccaggtactgtgatcgctcaactgatttttgttcttatgaaagtgttttttgtgtgtgcagagttgtttagtttggtgttcctatggggaagatgattggtggagcttctatttggccattttgctctgccttctccctataaactcatacatgggaatggcagtagttatgtactcaagagctcaaggtccttccttttcactgataaaacgaagtaagctcgtggttgtgatatgtgaaattctaaatcaaggcagtactccttcactttctccatcctgcgtacaccttggcttctaattagcctagcagatctagagctccctttactcagaccctgaaagtgaaacagtgtaatgtgaactttggtgttagactggggttcaaataatgccttggccatgtcctaactgtgatattttcaagttttttcttttctttctttcttttttttttttttttttttgagacagggtctcactctgtggcccaggctggagtagagtggcatgatctcagctcactgccacctctgcatcctgggcttgggtgatccttccacctcagcctccagagtagctaggactacaggcgcacaccaccacacccagctaatttttctatttttagagaaagagtttctgcatgttgcctgggctggtctcaaactcgtgaactcaagggatctgctcgtcttggcctcccaaagtgctgagattacaggcattatccaccatgcccaacctttgcaagtttttcctattttctgatcttattatttttttcctttataaaggtagtgacatctacccacagggtggctatgaggttaaataagagagaaagcttttagcccagtgcctggagttctcaagatataggagctattactataattattaagttcattatccccatcagtcccaggaatctatttccagccacatttcacccaaatgtgagatcctttcccaggagtctgtgtgttctgcatggctgagaaggcaccaggctattctctgctcccttagaaaaggcattttcaccatcaaatggctctactgaatcaacctaacattttcccctcccctgccccctccgtgctaactacattttggcacttcttcaaggggctttctgtaatgagcaggttcccagagaaagctgtttcctgaaaggcttatagcatttaaaagaaaacaagtttagggtctcagcattcttgcttttgaagaaagaaagaaagaagcttaatctgtaggcctggcagctgtagcaggagcctcaggctttcctgatcacaaacctaaagaaccaccatctcatcatgcatgctatttctcagctcctttgcaacttcattctggcttgccgatttgcctggggagggtttggtgggaaacccaacctctcccctaattctttgttcttcaaattagagctgggtactgttgccatcccaatcaacacaaataaacccttttcttacagtagcatgaaatatagtggcatgagtgtgggcgttgtttctctgacaggtttagagacttgtggtgtagtgaggggatgtacatatatgggggctaaacagacttgggtgctggtctcccacaccacaacacagctgcggcactttgaacaaattatttattctctcttagctccattgtctttcttagttcaactgaaatcactgtgtctactctgattgtgctatgaatactacatatggcaatgaacattaagtgcctagcatagtgccttgaatagtctatgtacttaattaattttaatccatttatgagctatatattcattcatttgatgaaatgtctcctgagctctttgaatgtcacacagtgttaggcattgaaaataaagaaagtaagcaagttggacatggtgtcactgctttcatggtgggtacagtcagtgaatctatgttttatacattgggtaaggagagttgaagataaatgaccagaatgacatagttagtcataaaactgttaaagttgtatgggacctcggggactaaataatctctgtgcaaattagaatacattgtatagcaaaggggaatagtgatatatttaaaatcacatggaaagccaccgagaaaactggagcttaactcataattaagtacttttctgcattctctgctctcaggaaggttatagtttcactgacagatgaaataatttgtgaagagaatgcatcagtatgtattattttgcaaaacaaaacaaaaaaaccccaaaaccaaaaacaaaataacctagaaggatctctacttttagggagttattgaagggcaatttgtataaaaagggagacctagatctaggccttgatggatgatgagttgggattgaacattctgggcagagagaaatgcatgaaaaacactgccatttggggaattcttcctaagatgctagaatttttttaaaatacagttttagtgccacaggtattttctcttagaagaagctctgcttaacatagatatttgtctcaatgggtaataaattacaaagaaatggcactacatgcatagatctgtctttccatggctttctggattatgaaaacattaccccacaggaagattatattacatctctgatctttttctgaggggtattgtagattgagtttgctccagccccaacatgaatatctcatttaagagccattaaaattgttttctatctctaaaatctgtaaatttcaagtcagtcacacctttttttccaatgggacctcacacagacttttcacgagaagccttttcatgctttcagaaatcatcatttgccagaaagaatattagctactcagcctaaatctacaaagggaggcaaaagtcaatattcagtatgattcataggtatcagcctcataagaaaaattcataaatattaggaaggttaacttagatatgacacatgttgattcttattaagtttcccactgaccctaggactttcttggggcaaggaattctgtcaagtgtaatgatatccaaatagatttgtaggatggctttttccttacaaactggagtccaaattattttgaatatagtaaaagcaactgtaattttttccctgcttgccaaatggggaccattgcctctcttttggaaagctctgtgtccaggtggactgagccaagatgttttgggcatctgtaatgttttgcagggttggtttgtaagagcaactcaacagcctcagttgattctaccaactgctcgccaccaaatggtgaaagtggtgtgttggaactgacctaggttggagccctcacagctttctattcagatggaaaaataacttttgacaggttgttgagctgggtgagactggctgggaggccacttcttatgattgggtgggtatagattttctatagcccagagttaagaaaacagtttgcatagcttacaaaatttcttctcccttcctgccaaagaaacaatccagggaagtaattcatctaggtacagcggacgtgagattgtgtgttggctttgtctttttatcagcttagctcttagaaaacttacttgatctgttggctgcctcacctataaacagaggcactgatatctaatttgtaggtttgttgtaatgctcaaatgagaggtaacacataaaacacttggcaaacaaaaaaaaaatcttaataatagtagtaatttttttaaaaatcaaattttaaaagaatttcaggggaatttaatggaagaggttcctaaggagtgaacacactgaaattcagaaagaagcccattagaatgaaacaacagatttctggatcttatcccagcttttctatgcctgtttcattttgtcagggaacctggaagtgaccaacagaaagcactcacacttaaacaagtctgcatgtgacgaaagtctaaagcagaacagcacttgatgcatttatacctagagagaaccatgattaccccatgggcttcagtatgcctgattatctaattctttgctctctacaaagaaatgtcaacaaggagagttaaatctctactagggagagagttattagaaaatatagagtgaaaaatgagtcaactaaggactttattggctagtgtgaaaaaccatgaattcctggttggccttttccatggtaggaataaaattctaaaaaatccccaaaaccccaaacaaacaaacaaacaaacaaaaacatggtatgttcatgccaatgagacaatgtctatcctgaaacactttctctccctcccttcctttctccccgtttaagtatactgaatgagcagaataggtgggggtggggggatcagaaaaaggctatttttcattaaagctgctcctatggaccccatgtcaaatcctccattcctgccccctcagatgaaaatctttggcagcccaacagcagatctgctcactcttagagaaaatctgtcttccatccatttcaaaccgcaatgcaatttcatttcaataatcaaaatatccagtcccctttattaagtcaaaatgttaaacttcattacaatttaagtttccctccttcttagctcagaaagcctattgttggtaaggggtgtgggtgtaggtgtcctttgatcagttgcttttatcctttttctgcaatttatacttttaattcttcctctcagttgtagaaaattatgttcaagtcaagggtggggaggtgagctgggcagagaaaggtttagagactagcgttatcgcgagcaggcatcagtgctgtctggcctgggcagttttttaaggtggattctcttttggagttctctgtgcataggtggagactccgctttgcctttgtcttatttctgggggttttctgtattagtttgttctcacactgctaaaaagaactacttgagatggggttatgtataaagtagagaggtttaattgactcacagttcttcatgactggggaggctcaggaaacttacaatcatggcagaaggtgaaagggaaaaaaagacacatcttacatggtggcaggagagagatagagaggcggtggggggaaccaccacttttaaactatcagatctcgtgagaacccactcgctgtcatgagaacaacatgggggaaaccacctccatgacccaatcacctcctaccaggtccctccctcatcacatggggattacaattcaagataagatttggatggggacacagagcccaactatatcagctctcctgtatcatgtcagtgaatacatctcctatggctggttgcttaagaggctgcacaacctctgctgagttttcatcagccctcctggttcctctcttaaataaagcctgttcagacggctcctgcatggctagcttgctctgtcacttggatccattatcagtgacatgcagtgacttcccaatctgttctactcagctgctacaggctgcttcagtctaccatctcctctttaggttttataggcatgtcagtctggtcggtcatgagtctcctgagcatcctccaaactctaggaaatacatgtagcctcttttattcatctctttgaaactcatttagatcaaaatgaggggaaaataagtctgtcatgggatggaagtggaggtaggacttaaagcatgcttcagtgacaatccatctctaatgtccagcttaaattatgtattcctttaatgtattaggctaacacttgcaaaatcagttgtaagccatctcctttgtcatttctgcatagatggacaagcagcttactttgatatgttaattattgtttggggcatgtagctgaaaatgaggctgcatgccatcaaaacctcctgttactctttatttctttctaccttcctatgtttatcatttcaccagaaaatgttgcatgctctttagttatatactaggcactctgttagatgctggggatataaaagaaagtaacaatggatatgacaaacaaataaatgtactattataatacaaggtaataaatgccattatggaagaaagagaagagttctatacctaggaaggtagagaggatagatctaactctaatctgtaggattggataagctttctattctagtgggaggcattgtctaagctgaaacttgaaaaactaatagaagtgttaagaccaataatttggtttgaggggaagtatcaagtagaatggagaatatgtgtgcataagctagaagaaagtaagaatctggtacattccagacaataaaatccaatttgcatgaaatatttacagagagtgtgggtgctggagtatggcatgagattagaaaggaaattgcagtaaaataataaaagtttaagacttttatgatgagtacaaatgaaaacgcctatacttttgaggaagtgaatctgtttataaattgtgttcttttaggtatatttggttactttccatttcagaggatctatcctgtttgtagtgattagaattggaagctgtttaagtctccttaaccatatttgtcacataccatctcattcttccattaatttggcaagcatatacagagtcccactctagccaagtcctctataagaccctttgaactggtggctcaagcctgtaatcctagcactttgggacgccaaggcgggcagatccctgaggtcaggagttcaagaccagcctggccaacatggtggaacccccgtctctactaaagtgcaaaaattagccgagcatgatggcgggtgcctgtaatcccagctactcgggaggctgagacaggagaattgcttgaacccgggagacggtggttgcagtgagccaagattgcttcactgcattccagcctggatggctgagcaagactctgtctcaaaaaataaaataaaataaaataaaataaaaaaatgttctgtccatcaagtcttgcagaggagacagagaaagaaatcaatggtgaaagttttaaattctataatacagggtcagctagtctaaattttgtaatagatgttttccatgggatgatagaggaagaaaatgaaagaacatggaagaatcaagacgaagccaatttggaggtaggtgtgtgtggaataaaaaatacttccaagagtagatgatacacctgagccaagggctgaaaaggtacagatgttagccaagtgagtgatgggcagggagacccactctaggcagaggaacatctgtgaagagacaggaagcacgtgaaggcataacatattcaggaaaatatcagttgcccagattggctggaagacagaatgggtatatgtgggaattacaagagatgtatttggaaagataagtgtaggtatgtgagggagcagatcaggaaagccttgtgtgccttattaaaaagtgtaggttttcttactttaattttgggaaggtaatggagtctctgagtcataaaggcctctttctgtatcttttctatactgacaaagcttgttattactcttaatacttatatgaagtgtctagcttatggaaggtgggcagtgactctgggattcacaagagaactctaaacttaaaaccctttagcaatagcttgctggggttgttatgtagaggaatgcagcaggaaaacacagcttgtcaccaacaggagaagttcatagaacttgcagttaagtgccctgggaaggtgtggagctcataaaaacaggccaaaaccagtctgtctaaaatgatgctgagtggccaatgttcttctctatgtaagaatttggaagcccaggttaccttacaagaggctgatattctgagatgcaaacacgatgggtttattgtctttttgttttgttttgagacaggatctcgctctatcaccaaggctggatacaatggcgcaatctcagctcactgcaacctccatccactgggttcaagtgatcctcccacctcagtctctcaactagctgggaccacatgcatgcaccaaccaccaggcctggcaattttttgtattttcagttgagacggggtctcaccatgttgcctaggatggtctcaaactcctgtgctcaagcaatctgcctgcctcagcctcccaaagtgctaggattataggtgtgagccaccatgcccagacagccttattttctaaatctcagcgttctccaaacattctaatatggcttattgttgctgcggtggaagttttgtcactgggttttttcccccactctttttcttcccctctgccccaaaactctttggataccagagcattgcctgctgcccttaaagggaggaacctagctgatctgactctgatccttttagcagtatgtactttagcatatatatatgtgtgtgtgtgtgtgtgtgtgtgtgtgtgtatgaatacatgcatataaatatatgtgtatattttttcatatgcatttatatagatacatagcagggaggtagatggatggatggatggatagatagatacatacatacatacatatatttgcatgatacctaaaagagggaaaataattacatttgtctcttttcaaatatgtacaggaagtgtagcccagtaaaggaatcacttgagtgtcatttttgtttgttaaatttaaattttattattccatcttttcaactatgattcataggttactaaaaatatctaaagtgaattaaattttggacattaggatctaaaattttcacaataccagatttatcctggaatgaaattaaatacagctgttattttagtggagggatgacagagttcttgtaatcttcctattcttatttcaattttctaatttagtgtagatcttcttatatttctttctttgtgtcttttctctcaagaggcttacagtaagcctccatattaggaggcaagaaaatgaaattgggtggatggttcattgtcacctctggtaatgatgacaagactgtccatgacaaccatccctgaaagtattctcctcttccatggagttggccaaacttacctgaccagtatgtgaaaaatttggttgaaaagtttggtcaattttggaggctcagttctgtccttaaaaacgtgtcaggactactaagatccatgttgccagaatctgacaagaacctcttttccaacctgatcacctctttttacctctatccaccttacacttagcttcccaacctgtgtctgaattccctggattcttctcttttgtacaagaagcctatgccccagagagcttatctatgcttttctctgattttcttctttagtgaaactccacactgttccaaggaataaatgagataatgcatgtaaatgtcttagcacaggccaagtgctcagtacccagaagaataaaagtattaataactgctgcaagccctatgatggattttaggaaaatatgagtctaccttaaaccatttatcactccacctaagaacatgtattactgtaaatctctattaactgggtttctaattggcaatctattttcttaacgcctccactcctggctcctccattctcagtgggtcactgtgttgcagaagacagttcgtcttttcccagcaagaaggtccatcacgatgtctgagttcgaatccaggttttgctacttaccagctgtgtgaccttggacaatttacctccatgggtcttagtttacacctctgtagagtggggataataatagtgcttgcctcataaggtaggggaaggattaatcgggttaaaatgtgcaaagtatttgcaaactatctggcccaagcgatgatcatatgaagatatatcactactatcatgaatctccctgcatttagtccatgactaacatgaagctccccaagaaaggaaaaacacacacatataaatggctttcttagaaaggaaactaatctacagagctgcacatctacccacaaggaggaccaatcgtatgctattatgcagagaatagtttatcttcacattatcttgaaataaaatataacagaatcttggaattttgtttttctctgagaaacaaagtttcattaaagttttggactttgctcccccacacaaaggcacaacaagccctgaaagatccatttgagtacccactcctacagaagctagaaaagtaatttgtttatcattaaaattaaaaatatcttgccaaaactactggaggacagtttcagctaggttctctgatgacatattaagtgcacgtgagattgtgtaaattttcagtagcaagctctcaaatcatatttgtaatggtaataataacttgcattactgttacataaatgttaaggattagaatatattacttttttttagacagagtctcactctgtcactcaggctgtagtgtagtggcattatcttggctcactgcaacctccaccacctgggttcaaatgactctcatgcctcagcctttcaagcagctgggactacaggtgcgtgccaccatgcttggctaatttttttgaatttttatttttagtagagatgggattttaccatgttggccaggctagtctcaaactcttggcttcaagtgatcctcctgcctcagcctcccaaagtgctggaattacaggcatgagccaccacgcccggcctattactcttatgagttgaatttttgtgttgcctaaaattcatctgcaaaatgctaattccctgtgtaatggtgtttggaggtgaggcctttgggaggcaattaggattagattatgttatgaggacagggccttcctgatggaattaatgccctcctaaaaacagggagtcatgagatccatctctgccttccatgtgaggatacaagaagacagctgtttgcaaactaggaagagatccctcactggacaccagatctgctggcaccttgatgtactttccagcctccaatactgtgagaaataaatgtttgttgtttaagccacccagtctatggtattctgttatatcagctcaaactaagataattacattaagcctaatacaataactatatattttatactaatataactaccttcatcacttttatttgatagtgaaggaaagtcttctatgaaattttcacctggggatctcatttgcacttaaatgattccataattaagttataagagcagccttgccagctttctaaaaatctgcatttaaatttcacaggctgcttttacaacaggatggataatgtactttgctcctgtctcatctcaagtctctctctctcctctctgtccctttctttctgtctaacatccatctgtgctttgaaacctcctgaataggatgtgacagtatctggaaaagtgtgaggtctgtctgcattaagttgttggcacatttcaattttaggaaagtcataaagcccttataaactttcataataaaattatcaaacaaccgccgggcgcggtgggattacgcctgtaatcccagctctttgggaggccgagacaggtggatcatgaggtcaggagatcgagaccatcctggctaacacggtgaaacccgatctctactaaaaatacaaaaaaaaaatagccgggcgtggtggcgggcgcctgtagtcccagctactcaggagactgaggcaggagaatggcgtgaacccaggaggtggagcttgcagtgagccgagatggcgccgctgcactccagcctgggcgacagagcaagactccacatattaaaaaaaaaaaaaaaatcatacaaccaatctctacgtattttaagtcacattatttcaaggaaagaaaaattactttgtgagtatgtacactaaagaatctaattttatttttgtgacaaaattagtgtgagatggttgtgatactctgaggctagcagaaatggagactctctactgtgagaatcacattaagtttgtatttaaagcacaattattaaaccttctgaattatctgcagttaaaattatttacattatacaatgtatatgactatcaaccatatgagaataacatgtggaatctgcatgaatttatataatagaaatgtaatgatttatgatcattttgctccattagaagatataagaagaaaaaaaatcaatagatctcattcattcatcagctcacagtgattaaggatactattgcataacagatcaggtgctaagtgctgggacacaaagataaattagacgtgttcctctacattgtaaaggaccctaaagttcatctaatagtcagtgatggaacagactcagagagtggtctatttgctcaagatcccagaactagttcatagcagaactaggtaaaaattcaagtctcttgactcttaactttagcctgatattgaggccaaatgacagctttaattacgacagagaagtattaagaatgtcattttggaaaattcaaagtccactagaggaaaactcatttcagttagaggctgtttcttgcaatctatttctaattcttggtcttaggcctcccatgtgtactgacagctggtaatatatttgggtctttgaagaaagcaacaggacctgtttctttctacgcactaactgtggctaagcaacaagacctactctctactgggaacagaattggaacccttaacttcctgtcagccacagcccacactggatttccctagaattttctagaagcaaatggctaccacaggaagaaaaccatagaattcagctggaaaccatccaaatttcctcatcctaagcttcatctccagcaagcctcagtcaaggagacccacaccacaaggctatgacataattcttggttgcctgccaaaatagagaaaaaaggatgaaaaggaagagtttttattgcaaaaagacagcttagggaattttttcttaacttagtgagatggaatcctgagacaaagatttgttagagataacttgtgtaggggtattaaactcaacagagataaagggagatgggtgagtaataagaaaaataaattaacccttggtgttttcttcaggcaatgctgaaaacacacacacacacacacacacacacacacacacacacacacacacacaaaaaaaaaaaaaaaaaaaaaaaaaaaaaccttatgcccaccacatcatcatttgtatcttaagtaaatgcttggggaaaggggttgagccaggaaggaagaacaggtgttgtacatcgaaccaagcctaaatatttggtatggaacagttgaagatttaagattgtaactccagaacttctgatcactttttttgtattgttaagggtagcaactgagattagataactcacttgctgaaggaagcacattcttggctctgtgcgacattcactgtgccatgagctgctagtgcttactgatacccatgtgctctttggcatttcccagtctcccttgcacttgagctgaccatgtgactatttctgaccaatggactgagagtagaagtaatgtggtcacttctgagggaggtagttaagtatcaagtgtgactcccctcaactcttcgactccttcctgcacccctgcagctggaagaggaggcttggagatggtagaaacataagatggaaggggtctagatggctggatgactgcttgaggagagttattcaagactgctacttagctgatgtcagactctgagtaagtaagaaacttttgtaagatacataaaagtttaactgtaggaagaaaagtcatttttatccatgaaaataaaagatgcctaagatgtatgttttcaaattatattgggatttatatatttcactttatataaactcaaaatcatcaacatatgcctttgttcacttgcttctctgaacttagaaagtctgtaaataaatgtaatgtcaaaagctgaaaacacccaaagctactgtgatttgtggattgttacaacagttaacgagaaatatacatacactaaatgtgttctcctcattttcttgtgtgtactgctccaatctttttcagatgtaactgcttccccaggttaaggggagagtaactctgctccctgttctgggataaaatcctctttggtctcttggccattccctttgccagtgactggtttaggagtagagatgggactcaatagttacactttctgggggcctctgaaaaagattttcttgttcttacagaaaagtcacagattgaaattgctcatttctgaatagaaatggagatttggagggagaggtaatgcggcaaaaaactctaaagtggttgcttaataaagtgaggtaattttcattgtctagtcaaaatgccaacataccaaatatggttgattggggccctgaaactgaggacgagaagcaaggggaaagagaaggtcccaagaacactgtggtaagcagggattgacagagaaatatctccctaaggagggcaatggcccctgacctattagaataataatacctgccccctaattttaaattgtttcatgtgtcataatgtccttttgttattgcagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcaggtaagcacctctatccctccaatcttcaaaagcatgccgggcgggcggatcacacattaagttggaatgtaaacagaagtaaaggagtatgaagaacactatagcaaggaggaaaaaaagccacacattttgtgccagacagacttagtttgaaatcctatttatagattttgtttcattaggcaatttatttcattctctgagcttcaggggaatcttagtcattgcagttctattacttaacaaagtctttaacagttttccacttactatgtaacatatatatttataacatcttgtctaggatgcagaagagctgtatcttgtatttcctttgctacattcagatgttctcataggttgcttcatgtgtaaaatgaggacaatgccattgttatactctgaaccaagttattggaggaagcagtgtgacaagcacctcgtaaaccctgttaaatgtgcagataagctattaatagaaattattgcaccaatttgatctgaagactcttccagctttgcatgatagatgcattgtcatgtcttatgttttgtaaacagccacacttcaccactatttagataaaatgtgactaagtcaaccttagtttccagacaaccctggatagtttttactttatcttgtatttggactggcgttgggacctctttagctgagaattcccctcccctctgtgagccattagctgagaagcaccattgtcagaaattctgaggatgacctgtcacccccacagccttgccctttctgacttttcagccacccgcccaccatccccatctggttgaggccttggtcagtgtgggagaacaggaggaatctacttagctgagtcatgacccaggtctagcttatggtataaaaccaattaaagcccctttatctgtggcctgatccatcacatgggggtattgagggaggtgaaattccagcctcatttctcttggcagcttctgtgaaggggtagggttcccggtggtcatggaaaaataaagcacacagaaaagggggctgattgctttcacttcattcctgctgcctcccccagaaatgttctctggccaaaccaaatcccagggctcccagaagacccaatgtacccaaagccaagagcaactcctacctcgctgccgctacttactgtccccaaagggcctatctagaggatctggtcaggaagcttaaaaatagttgagtgtgtggtgacaagccttgtggatttcctttgtaaaaatattccaagcagggaaataaacctttcagcaacttatttttccattgctctgtggagcagctcccactctctgctgctataagtacttcaggtagcttgtgggtggtagtggtggtagggatgccagaggggaagtggaggggagatgtgtcttgctcagagaaccaggtttagggggccagcaactattaggatctagaggcaacataacatttctgcacattctgtatacagaaggaaatgtaattccaagctgctgagtttggcacatgaggcctttccagatctagctgtgtccactgccccagcatcataaagtgtcagtatcagcagttgccccatcacattatgatgcttgattcctatatggcttcccatcctctgttccttccactgggaacctggaccctcaccatcatccccagtcatcatccaacctgccagtcattaaaatccagcccagaagtctgccttctcagtgaagtcttctctggcctaagagttaatcactgttttctgaacaacaattctgtcatcattgcatttatcatatggtggggtgttccctcatggggtttgttttctatgcatcttcatgtttttgcagctgcgtacaggatctggcaatgatcactactgccgaacaggttaatcgagcaatttgaagatggcagtatttctgccaaagaagacaaaaagacagaacgaccagtttacaggcagcttagataaatgcaggtttccatgaggttaaaattttgtggaatgctcatgtccacttcacatttctgtcagtaaattactgtgttagaagttgtcccaaataacactgcgaagaactttgagaacttttgagttaacaaagaaccttatcatctttttcgttttcagcactcccttgagttaagatgttatgaccccatttttacaaatgtgaaaacaatttccacagaggaggtagaagaggagagatagagctgagactcaactctgattgcctgtatccagttttttctttccacaaatgaccaaaaagtaccaaaaaacaaagaaactatgagaaaaatgctttctaatagttgtttactattatgattataactactagaaaatataaagcccacataagattttatgtctccaaattcaagaaaatcaccaaagggcaaggcatagagtagcagacaataggctgcatcctcacctggatcccggaagggcttggccatcctcattgatgctatggcagcactgatacctgccaactactctcaagggacaggacagcatggtggttcagagatcaggctctggagccagattgtccaggcttcaatctcagcaccccacctatttctatggggtctggtacatgttaatctctctataccacagtttctccatctttaaactggtggtagtaattagacctgactcacagaattttgtaagttaatagtatgtaaaagattaaatggcccagatacagtggctcatgcctgtaacctcaacactttgggaggctaaggcaggaggactgcttgagtccaggagttcgagacctgcttgggcaacatggcgaaactctgtttctacaaaaaaagaaaaaaaattaaaaattatccaagtgtggtggcatgtgcctgtagttccagctccttgggaggctgaggtaggaggatcactttagcccaggaggttgaggctgcagtgagccatgatggagatattgcattgtagcttgagtgacagagaacctgtctcaaaaaaaaaaaaaaaaaattaaaagatcaatcagtgttatctactatgtgccagttatttaccatgacaccatcagattctttatctttcattctcataagaactaatttaggtattattatctctattttatctatgaaatacctggggctacaaggttagatatttttcccagtgggagttctgggttttggatcacaattattgtgaatttaaaattctatatacgtcatctcttacaataacaaaatactcaattaattttcttttcatggatcctggaaacagccctcctttgggaccttactgaaggcttagatacatggcttagacaatctgtggaggtccaagcggcaagcttgataaactgggatttcctgagctcttgtcagcttctcaagtcagagttaatgctgaaagttctacatggggcatgggtgtagcttagataaatacccagaggcttgggaggtagagtgaaaatattttgagctggcaagtctgttcaattaatatgtacttgggagacattttcaaagctgacagatcttttgtaagtgccaagtgatattaattattagtataaaagcagatcccaccagtggagtcagagacacccaaatttatgtgtgttcgggtgtatcatcgggttgtgaggttgaggatgccaacgcttctagctgtgagggcaaaatttagcaaatgagtgtaccctaggaatgaggcaagaagagtctgaacctcttctttgtgtagtgcagaaatctggtcttgtaggaaagagttgctctcagtcttgccagagtcctgctcagaaggtaaaagtctagtgggctgcccaaagggaaggtgtgcaatatatagccttatagcctgggttgaatcaggcaaaacaagagaaatatggctaatgttttaccagaggataaagcagggccataaatgagagaaaaatgaaccctgagctcagaggtggaaacaatatacaacctgtcaggaagtcaagtccagtgtaggtctggaaagtgcttcagaagggagtaatgaatagtgtgaggtcctggcagctctgagagtgcaggctgcctgccgcttggtggaggatgacctggtctcttacagccttttcagagagtcaggtagttcccctccgtgaacctaacagcttctgtgtcttctccaggtgaatttcactttacatcttcaggcatgtttctgattttttgcgggggacagaggggaggagggaaagaagaatttattcttggaggtagatgatccattcttggatccatactctttgtggtagatgatccattcatgagctctctatgactgtgggtgaggtatttcttttcttttgtaatcagttcctgatccgaaaaattaggaatgggctcagaatgttccctgttttcttccattgccaactttccataatgtacagaactggcaattcctttcttttgctaattctgcaaaacctaagggtctttctgagatgtcccgtgggctagttgagtaaatctgggaatacctagtaactagggctgtgttaaaaaggacatttttggttttatctgttttagggttcattaaagtttaataagctatccttgggggaaaataatgcatacatatacaattatttatatatgtggtttatcccttttgtggaatacggttttgtgtgggcttaattatttaaaagaaatttatggcaggttataaagccaatttttgcaatgtaaacaactcccactcattgttttgaaattattgaattttattaacaataattataccttgtatctatgaagcacattcgattttattaaatctagttgtttgtgtaataacgggttcagaaaacacctgtgaactaggcttttttcttttgaaattgctttattgttttctttcagtcataaaatgaatacataacagcagggtgctatattaaatatttacttattttcttctagtgaagagagagccagacactacactaccatggtcattcttgggagaatgattcacttttgaggcaagaatgtggctctctttcccaaaacggatgtagaggtctatcaccagaggcaattggttctccttgttagggaaataagcttcacaattcttatgcctctgttgtagtgaaccacattctctcaaagagttcagggaagaagagaaaagtattcagggtggaggagaagattcattactggcaggaggtgattgagccactgcctctggcacagcactccttggtgggcttgccttttggctctggatggagctgagcaagctaagcttgtaggtctctggcctgaaaacctaggaacattgcagccacaagcttggcattgagggagtggaagccctatcctctgagaaagcacatggatggcccatgcaaggaacctgaatcagcagtagccaagtgacatttgcataactctttgtcatggataagcaaactttgtggaaagatgcagattaaataaacattttgggctttgtgggccacataatctctattgtaactacacagctttgccactgccatgtacattgagcaacagcatggatgttactatgtttcaaacaaaaactctgtttacaaaaagttagcgggctgcattcagtctgtgggccatggtttgctgacacctggcttgggatattcccagaagtagagttgccatgtcaaagtgtacactcttttctagatttttctagatgttttcaagtcaccctccagaagggtaactgaattgaatccttaccatctgcatgaacgtacttgtttctctctatcatcctcaatactaggtattttcatttttttaaaaaaggcttggccaggaggctcatgcctataattctagcactttgggaggccaaggcaggcaggtcacttgaggtcaggagtttgagaccagcctggccaacatggtgaaaccctgtctctactaaaaatacaaaaattagctggaaattgcttgaacctgggaagtggaggttgcagtgagtggagatcgtgccattgcactccagcctgggcgacagagtgagactccgtctcaaaaaaaaaaaaaaacaaaaaaaaaacaaaaaaaaaaacaggaaagcatctgtactttaattttgcatatggaaaatggaaaacattaaccaaagtgttaattttctttttctcactgaagtccacaaagcaagaaattgacaaatttggggttactacatggaacttgtaaaatcaaatcatattaatatatttggtgtggagagtctctgcaacaggaggatggtgtgtgtgggggagagtacctacagtggagggagaggttggagagtgtgtcacaaggattgtggtggaaaagatcgtttggctgcttcatgattgaatgggcatgcggctgatcaaggtaatcccagcagatgagctgcttgggatccttcattaccaatggcccacctaaggtgaatcttctaggatgttatatgacctatgtaggataacccttgcaagagaaatatgttggcttaaatttatgtgtcccttccctctactgtatatcttcccaataggacccaggcatcagaaaaaagaaaactcattggagattttaggctgaactctttggactcttcaaggatgggagaactgttgactcacttgtcaagattctcttttgttttctgattttttctatgaccagccatacactagccaaagaggtgaactaatagagtacactctttggagacacacatctgatttgaatcctagctcaaccctatagtggctgtgtagactcagacctagtctctctaagcccatttgttttaatgtaaaataggcacaataacgtctccctcttaaggtgtttgtaagaattcaatcatcacatgtctggagagtgtctaggcaaatgggaggtattatgtgtccaactccaggacattgctcataaacctgtgatttagctcatagagcactgggcacctaaggagatcaaaagatctggattgcactgactacatcaggtggccaaggattggttggattagtggggcctctcaaatcacatttcacagggaacaatcctatggagagtgattaggaattaggttcaccaatctattttgagaggatttggtttggtccagccaatattttgaagtactcacaatgccaggttctttgcttcgttcttgaaatatagatatgaaccaggaattaattctggtgccaaggaacttcacactgtagagatggatatgagcaattaccaaaaaatattctaaatattatctgataaagtttttaatggaggaaatcataggatgttaccaaggcaaagaggaaaaaatccctaacttagatcattgggattagggatggtttctcctaggggacaaaagagcttaagtcttcttgatgaaggtgtggtatatatttgaatgtgaaggcattaaattgaatgatgcatataagagaatagaataagtattgtgttgtaggagacataagatgaaacttgggggatagcaagagatgtcagttatgaaaggctgatcaaagtcttcattctttgaaagccattgaaacgttttatacaacagagtgacaagatcagattcatgtttcacaaatatctttttggtttcagggtggaggatgaatagaatggtgaaaccagaggcagagatactagttaggaagctagttcagtaattcacatgagagatggtggtggctgaattagggaagtggcagtgcagaaggggaaagggatctatgcaatcaatattaattggtaaatttggcaagattgggcatgggttgcatatggaaaatgaaagagagtgagaataattcccaagagtctgatttgagcattgggtggttggggcgggaagtgagggtgggggcattccttgatacctgaacaatggagggggtagagatgatgagtttagaaagcagaagagagacttcaaccaggaacttctgggcttggaatcaggttccatggcttctgacaaactgtgctgactatgggcaaatcactctccctctttagctttagtttctcattttatcatgcaagtaaatattagactgaagagagactcccaaacatgtatctgtggtcacacaactgtagactctgatttactaagtctggtgtgcagtccaagaatcagtattttcaaaagtttcccaggtgatgctgttgtccaacaggtttcaagccctttggagcaggagatccttgaggattcttacagctcaagcatctcttaatgcagtttcctcctagctcttgctccttcctgctgactctgcagatatgagctggcatctaatatccagtgtggccttcacagacactaccatgcatgccagtatccacagtgtgtctcactttctctgtccctgcaccccttcctccactcatcacacggattgggcaggcagaaaaagccaagagtattacccttcacataattggcaccaaggcaactccctgccatgtttttccttcccaaagacatatggttgatttcccaccaggatattgtataataaaccacttctgtagctcattgggatggagggttagtgattttgttccaagtgtggtggtaaatgcattttttaaaaggccttccctaaacttaaagttttagtagacagaacacatccaagaattgagcatttatcttccacatgtgccgggaggacatgttacttatcttctctcttggtacttccactgatcccacttcctgctatggatgagctcagcagacatggcatgtagacacatggggaaaagtcatcaacacatctgaaaaattagtaatggcttggccatcaacagagaggcttaggtgttacttcttacaacctacaaacagcattaattacactgaaatctccaggctggaccaagaagaggatccccttacaccacacataagtgcatttgcctggagtgaaacagcacaggtcttcctctcactgcaaggctgtgatcaattcttggctcccaaacccaaaagggatgtggaaatctggtgggaactgtaaaggcctggaatataagacttatgtgcacagatgaaaggcagcaggcttgttcagctgggaggaactgtaggatggcttaattataacctcctggtctatagcgagttcttagatcactgatgaggtaaacccgctgctggatcccaagctgggagctacagcaaggactcaaacctatttatcttttatttttctatggtgtttgggatgcagctctgaataaagtggtggctgaggaaactgattcagcaactgcatttccagatccttttacagcagaaagagcttaactttggggtaattcaaacctgagtttgaattccaattacacaaattacaaactgtaactttggatatttcaactgcgtacattgtaattttcttaactataaaataaggttaaaatattgaccacatagggctattttggggaatgagagagagagagagagtaggagtagtctcttatctagtacagagcctggtaagttctttaagtattttcagagtgaaggattagataaagctatggagaacgtttagacagactatggtagacaagctagtagggtgatttgacgtctcaatttgccttggatggtgctagcttaaaaattcagcaggcatgcaaaagggtctcagattgaagggacaaagtgatttccctgtagcctctgaataacttaagctctgtggtttgcaggaacttagtgatgtggtcatgcatagtgtgcgtgtgtgtgtgtgcgtgcgcatgtgtgcatgtatgtaatatcttatgtctactactctgatgtcttttgagcttcttggaaacttggataatatctaatttatctcttcatttctctttatccctaaatcagcaaatgtgtgaggagaaccaatggtaattatatgccttgtataatatgagaacagatggaaaaataaacaaacaccaaatctcacttcctcctgttgcttaccttttagtggcagtgtcagatttttctcctggactccttctcctaactataatttaaaaaatgtatttcatcatgcaacttatttattttaaaaatctaaagtattacagataacatggaagctcttatccctaatatcattcccccttctctaaaggcaatcaccaatatgaattttattgtgtatcattgcagcccccattttctatgtttattatgagatatatccactaataatacatatggttgctatttcttacctatttacagaactatttcatactacagtttttaacaacttgtttcccctttgttactcaagattgcatttttgatatccattcatgtctttacacatagatctaattaattcattttgatttttgttattgtaaattgcatgaatatattacaatttatttactcattctttctccactgaaggacataaagattgtttccaatttttcttcattgtaaacagacactgctataatgaacattctggtttatgtgcaggcatttctctgaagtagaatgagaagtcattgggcatgcacattttaacaatttcacgatctacagtcaaattgctctccaaagtgattgtactaatttagactcccaccagcagggtaggaaagttcagttttctcatgtctttaccaacagttgctattgacagactctttaatgcttgtcaaactatttggtgtaaaatgcttcactgttgttttaatttgcatttcctttatttctagtgaggataataatctattcatatgttcactggctcttctgaattgcctgttcccatcaattgccaacttctgtgttatattgttggttcgtttaaactgatacataatttctctacctattcaagataatctgtgtttgttttacacgtgtgtttgttttacacgttacagacatattttctaagcctgccatttttttaagtatgtttcatggtgtgcttcgtaatggggaaaatcttaattttgatgcacttggttttatcaatgctttcctataaattgctagtgtttgagagttttctaagaaatttgatttttatctcttagtcaaaaattgttatcctacattctcttctaattaaaaaatcccatttgcagttttatttagttatttttgtctataaagtgagttccgaatgggaaaccaggtcatttactgcacttttttccttcccactgatttataatgccacctctgtcatacaccaggctcatatgtgtttcagcttatttaagggcttcaaattttatttcattaacttgactttttctctgctccaatatcattcttttaattttatgactttaaactgttttcatggataggtagtcaagttctagctcattttttcccctcccctcagaattatctttgctgatctttgttgtttgcatattcaaatggagtttagaataagtgcgtagagttctgagagagaaatcttgttgagattttatctgaaacctcattaattaaatatattgatgatttggatcaagttaatagctttgtgattttaaatatctccactcatggaaatggcacaactctccatatattttgtttcccttatgctgcttatttcataattttgtatacaaatttttgcatatatgtatttttaaatttattcataaacacctttttttgcttttatgcctgtacttatattgcattattactgatatgtatatattcttccacccttgtgagatcttagagtgactttgctagtttagtcagtttttcttagatttattatattgaggaccttatatatgatctctaaatatatactgataagcttaaattcttaagtatcatttatttttcttgccttattacgtaattagggcatccagttgactagtaaaagtaattataaagactctactattttcttttcttgactttaatagaaatgcttttaaagcttcatcattcattattatatctatagtagtttttcgctagatgtttatttttaaagaaagtttcttgttactgatagattgctaagaattttgtcatggattcattttgaattttattccttaattttatgtatctattgataaatctattttttcttttagtttgctcatatattgaattagcctactttgatagattttttttcctagttaaccatacctgcctcttttttgatgaattttaataggccattatatttgtttgttagttttagtgaagggttaggtttattatgcttggattttacttaagatgtttaatgaattttaataggccattatatttgtttgtttgttttagtgaagggttaagtttattatgcttggattttacttaagatgtttaaaattaagatttttttgccatctgtaactttattttattgtacattttttggagtggggatcttatgttaatatctcttctgaccattctattaggttggtgcaaaagtaattgcagtttttaccaatttcaatctaataatctattagtctataataatttcaatctatagtctattagatgactactattatctactagattattccacctactatttttattgtacatgctagagcttaagaaaatttttcatcttagactatgctctaattatatcacctgtgtgcatttttcccattgtaaaacaaattgtttttctttttgatatatattggctggtgccaattgttctctcagagaagtaaatgggatttttaaggaaaaaaatatctaggtttcccacatttaacttactaatcttagcaatggctaatagggaaattcccagatgaatcaaggaaatatctcaccttccacaacaataatttattaattataattaatcagattggtagctaactgtgtgttgggcactgggctaagtactttatttatatacatgatgttatgtatttgcaaaaatcatatggtataagcagtgctagtctcagtttagagataataaaatttggattaatggggtttaagttacttgctcaagtgtgcataggtggtaaagtggtgatttttatccattcctttctgactccaaatcacatacccttgaccactttgctacattgtgtctacaccaatgtttggagaacctaaagccacctgtgttaactccattccagcacttaagggagtttaactcaacaatgtctcctggttagtatatcccttatatctcagttctctctgcttaacatatacagatttcttttcaagaaatgcaaattatatttctcttgttctgtcttatttatgttttattttttcttcttacactgcgtccaagaaacacctcctcatgctttggtgtcttctttcttctttttcctcttgtctgtgtttagtttcctcgttttctagttagtcctataattcttactgatccttctttacttttacattagaaaaaaggagggtttaaaaagcgttttttaaatgaaagaaaataaattgtccttcattggactattgttcctccaagctaggaagttgatgcttgattctctgataccccgggggcctgggtggtgttttaagctgggagaagatgggcactctcctgaactgccttagatgcttccttatcctgggcctctctgacaggcaacatgcctcaactttgtcaacaagttgtggtttgtttcactggccaagcataagacagagcatgaaggccgagctgcgtgcctggtgctgcatgtttcctgtttctgtaagctatttgttgtcaactctcttttttcctttatgatatttaattgaaatcacagcttaatgaggcctgaccagtatttttcctttggtcacagatttgatgctactgccaatgtacctgaataagaagacaactctttctggaaaaagggaaaacttgaagggctattgaaggccgctagaaaggtattgtttacatgatgcattttccccttatcttcaacaggtaaaattgttactaaactgatgtttcctttaacaatgataatttttatttggtagtcttgggatgtccctgggagctcaagttcagacaatgaatctagatttttgccagttgaagttcaggttttgtgacctcacctaaaatttgctcctggggcttggaaagtttaaaattgtgcttttttattttccccttcttttttttagcacagttcagatgccatgtccctaggaatttttccttaattcccaaattgcaataatatatccatcatctgcacatctacattacttgtatttaaactgtttcatggcattaaccatgttttaccctgatgcaatgagatacaatgcagttagatgagagaatatgagtactggagctggacaggaatggatgtgaagcccgtggcagttatttactgggtgatcttaacatctcaatattttcttcttcataaaatgataatattaaaaataatagactgttaatatgacctaccttatcttgttgttgggataatttaaggaaattacacattgtattagtctgttctcatactgctgatgaagacataccaaagactgggtaatttataaaggaaagaggtttaattgactcacagttccacatggctagggaggcctcacaatcacggtggaaggcaaaggagaagcaaggacatttcttacatggtgacaggcaagacagcttgtgcaggggaacaaactctgatttataaaactatcagatcttgtgagacttattcactaccacgagaacagtatgggggaaaccacccccatgattccattatcttcacctggacccacccttgacatgtggggattattgcaattcaaggtgagatttgggtggggacacagccaaaccgtatcacacatgtaataaccttggtgcacaggagaagcaatagatgactatgattttaccatcctttgagttaatacccactatcactggtgcctgtaaagggctgcacttgtagaaagtatgactctgtctttccataacactaaacatgaaacctaagagcttttcatcacggggatttgtctcatcatctggcatgctttctttgacacctagccaacccagtaggctttatctgagttaacctcataaagtatcatattgtttcacacaggggtttattcctgaaagttacttaatggtagtttttaagaaaattaaatcttattttataggcacctgggaaaatcattattaaagtgagtcatatggctaatcgttttgcgtaaaggatccctttggaaagtgaataatctcttgttagttaccatgcgtatgttcagataccagcgcttcttagagaggtgcttaatccatgtatataaagtactctatacaatcttatacttctgctaagaacatttgccatggaatccagggatagatatacacgaatgatgttgtgttactttgtaaaatttgtctctgcatttttaataaattggtacgtaaatggattggtatgtatttggattctctacaacacaaacttctaagatttttagttttaggaatcctccaaaagccaaggaaaaactagaaggaaaatgatatttattgagcatctttttgctaagcattatgtgaatcatcttcactaacatattatagttattcctcatcataatgctatgaaaagtattgcttaccttttattggagagaaaaaaaatgaggctcagataagtaaattacactatgccaggtaattcagctagaaaatagcaaagtacaggatttgaaatcagatcttctggatgccaaatcccttacttattccagtaaagtactctttcttgagaacaatatactgaatttcaacgggaaataaaatttaagatgtgggtggtatttatcttactattcgggtacttaaaaaatatcgtacattatcttcgggccttattttttaacctgcctatggaacgtggctctaaacctttgcactgaggctagcttcagtgaaattttgaaggagttaatgccttcctctttttgatacaagattaaacatggattgcaactagaaaccacaaagctgagtgtttattaaatatactaattttcctttcatccagttggccaatgttttcaaccataatctacttttctctaaatttttccatggagcaggatgatgattccaaatcctaaaattctgaaaaaaaaaaaaatcacttaatgaccactggtgaactcctgtaaactcatcccagaatcagtaatgagtatttggaaaagattcatgggtaagctccaattctcaccaaaatggccctttgagtagcaatcaaggattctctgagggaactgggaagttccagatggcttttaagggaggctatttggtttagtttaatagaacttggtgctattaaggccaatggttggagtcctttgtcctattctagtatatatatacatatacatacgtacatacatatatactccttactctattaatgtatttagaaagtaaatagtataggttataaataggcagaaaaaaaaacagtgggaatggcttagtgtgaaccattaactctatatattcattcaacatgaatttgctaaaagcccattaggtactagtctctggagacacatggtcaacttgaacaagaattggctttgaggaaataatggactaagggggatatataaacagataattgtgatgtgtgttttttgttttttttttttttaattatactttaagttttagggtacatgtgcacatcgtgcaggttagttacatatgtatacatgtgccatgctggtgcactgcacccactaactcatcatctagcattaggtatatctcccgatgctatccctcccccttccccccaccccacaacagtccccagagtgtgatattccccttcctgtgtccatgtgacctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccattctatcattgttggacatttgggttggttccaagtctttgctattgtgaataatgccgcaataaacacacttgtgcatgtgtctttatagcagcatgatttataggcctttgggtatatacccagtaatgggatggctgggtcaaatggtatttctagttctagatccctgaggaatcgccacactgacttccacaatggttgaattagtttacagtcccaccaacagtgtaaaagtgttcctatttctctctccacatcctctccagcacctgttgtttcctgactttttaatgattgccattctaactggtgtgagatggtatctcattgtggttttgatttgcatttctctgatggccagtgatgatgagcattttttcatgtgtgtgttttttggctgcataaatgtcttcttttgagaagtgtgtgttcatgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtggagaagctctttagtttaattagatcccatttgtcaattttgtcttttgtttccattgcttttggtgttttaaacatgaagtccttgcccatgcctatgtcctgaatggtaatgcctaggttttcttctacagtttttatggttttaggtctaacatttaagtctttaatccatcttgaattgattttttgtataaggtgtaaggaagggatccagtttcagctttctccatatggctagccagttttcccagcaccatttattaaatagggaatcctttccccattgcttgtttttctcaggtttgtcaaagatcagatagttgtagatatgtggcgttatttctgagggctctgttctgttccattgatttatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattcagtgaagaaagtcattggtagcttgatggggatggcattgaatctgtaaattatcttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattccctttgaggcaattgtgaatgggagttcactcatgatttggctctctgtttgtctgttgttggtgtataagaatgcttgtgatttttgtacattgattttgtatgctgagactttgctgaagttacttatcagcttaaggagattttgggctgagacaatggggttttctagatatacaatcatgtcgtctgcaaacagggcttatgatgcgtatcatagtcttacagatttatatctacctttactaaaagaagaagaatgttgattaggaagtggcgtttattaagtttattaagtttagtagtaatgagaattattataatggtggttgcaattaccataattcattgatcttttaatgctaatcccagcactatggcctgtacgtgaattattctattcaatctaacaaacttgtgatattggtgatgatgattatgattatagtaacagaaataatggggaatataaggcacatgtattaaacgttattttcaagttactgtattgggtctttcaaggtattattttattaaatcatgccagcaactctctgcagttggtattattatcaccatgttgaagaacagtctgatgccaagagagtgtccacaaattttccaagaatgtacaatgattaggtttatgatttaaaatctgggctagatgaccccacagttcatacccctaagtacaggtctaccttgtttcattgtgcttcacttcacatatactgtattttttaaaaatattgaaggtttatggcaaccatgcattgagcaagtctataggtaccatttctccaacagcatgtgctcactctgtgtttctgtttcacattttggtaattctcacaatattccaaacattttttgttatcattatatccattttgatggttcatgatagtgagtttttgtttgtttgttttttgtttttttagacagagttggtgtctcagcctacggagtagctgggattacatgcatgcgccaccacacctgcctgatttttgtatttttagtagagatgaagttttgccatgttggccagactggtcttgaactcctggcctcaagtgatccgcccactttggcttcccaaagtgctgagattacaggcaagaaccaccacacccggcctgattagtaatttttgatgtcaatattgtaattgttttggggggccatgaatcaagctcatataagactgtaaacttaataaatattgcggtcagctccaatgactggccattttgcctctctcttttttggcctgcctattttctaggatacaacaataatgaaattaggccaattgataaccttacagtggcctgaaagtgcccaggtgaaaggaatagttgtacatctcacttcaaatcaaaagcaagaaatgattaaactcagtgaggaaggcatgttgaaagtcaagataggccaagagctaggcctcttgtgccaaagaatttggcaagttgtgaatgccaaggaaaagttcttgaagcaaattaaaagtactattccaatgaacacactaatgataagaaagcaaaacagccttattgctggtatgaagacagttttagtgctccacatagaaaatcaaatcagccacaatatttgcttaagctaaaacctaaccctgagcaacaccttacctctctttaattctaggaaggctgagagaggtggcaaagctgcagaagaaaagtttgaagctagcagagattggttcatgaggtttaaagaaagaagccatctttatatcacaaaagttcaaggtaaagcagaaaatattgatatagaagctgcaacaagttatccagaagatctagctaagataattgatgaaggtggctataataaacaatagatttagagtgtagacaaaacagctttatattggaagaagatgccatctaggactttcatagctacagagaagttaatgcctggcttcaaagcctcaaagaatatgctgactcttgttatgggctaatgcagctgttgactttaagttaaagccaatgttcatataccattcctaaaaatcctaagatttatgctaaatgactctgcctgtgctctataaatggaagaacaaagcctggatgactgcacgtctgtttacataatgcttcactgaagattttaagcccactgttgagacccactgctcagaaacaaagatttctttcacagtattactgcttatagaccattcacctggtcacccaagagttctgataatatacaagaagattaaccttacttttatgccctacgaacacaatattcattctgcagctcatggttcaagaagtaattttgactttcacatttcattactgaaaaaaatacattttgtaaggctgtaactgccatagaaagtgattcttctgatgaatctgagcaaagtaaataaaaaacctggaaagaattcaccattctagatgtcactaggagcatttgtgattcatgggaggatatcaaaatgacaacattagcagaactttggaagaagttgattccaactctcacatataaataactttgttcaagacgtcagtggtggaagtaactgcagaggtggcttaaataggaagaacactagaattagaagtggattctgaaggcatggctgaattgctgctgtctcatgataaaacttgaatgaaaaggagttgcttttatggatgagcaaagagtggttgcttgagagggaatctactctttgtgaggatgctgtgaacattgctgaaatggcaacaaatgatttaaaatattgcataaatttagttcatcaaacagcatcaggtttgaaagaattgtctccaattttgaaggaagttatactgtgagcaatatgctatcaaacagcatcacatgccaaagagaaatattttgtgaaaggaagagtcaatcaacatagcaaacttcattgttatcttaagtaatttccatagccaccaaaccttcagcaaccaccaccctcatcagtcagcagccatcaatactggggcagaatctccactggcaaaaagattaggacttgctgaaggcttagatgaccattagcatttttaaacaagaaagcatttttttagttaagctatgtgcatttttagatttgaaagacatttctcaaaagaagacatacaagtggcaagcaggcatatgaaaagatgctacacatcatccatcatcagataaatgcaaatcaaaactacaaggagatatcatctcacaccagttagaatggcttatatccaaaacacaggcaataacaaatgctgatgaggaagtggagaaaagaggacagtcaatgggaatgtaaattagcacaactatggagtacagtttagaggtttcacaaaaaactaaaaatgagctaccatatgatccagcaatcccactgatgagtatatattgaaaagaaggtatatcagtatattgaagagatatctgcactcttatgtttgttgcagcactgtttacagcaactaagatttggaagcaacctaagtgttcaacagatgaatggttaaagaaaatgcggtacatacagacaatggagtactactcagccataaaaaaaatgatatccagtcatttgcagcaacgtggatggaactggagaccattatgttaagtgaaataaaccaggcacagaaagacaaacatcgcatgttctcccttatttgtgggatccaaacatcaaaacaattgaactcatgctcatagagaggagaaggatggttaccagaggctgggaaaggtagtgggaaggtggaaagggaggtggggatcggtaatgtataaaaaaatactggaaagagtgaataagacctactatttgatagtacaatggatgattatagtcaataataacctaattgtatattttcaaataacataaagagtgtaattggattgtttgtaactcaaaggataaatgcttgaggggacagatacaccattctccatgatgtgtttatttcacatttcatgactgtattaaaacattttatgtaccccataaatatatatacctactacatacccacaaaaattaaacattaaaaaaagatatgtacatttttaagacacaatgctatgcacttaatagtccacagtatagtgtaaaagtaacttttatatttactgggagagcaaaaaaaattgtgtgacttgctttattggtatacttgctgtatttcagtggtgtgtaatcaaacccataatatctcagaggtttgcctgtacactaagccaagctgtcttctgagcagggtaaacactgaagggtgtcaggtagaaaaataaaaggaacacattctaagaaaaggaagttttttaaaaaatagttttgtaaaacagtatgttagagaggtcacttaatgagaatgtatagtgcatgaaggaaaacagtggtaaataaagcccaaaatataaattagtttcaaattataaaggaatgtgtatttgcattttatcctataagttgagaatcaaaggatagtcttccaagcaaggaagataaagattcacatctacattttttttttttgagacagagtctcgctctgtcgcccaggctggagtgcagtggcacgatctcggctcactgcaagctccgcctcccaggttcacgccattctcctgcctcagcctcccgagtagctgggaccacaggcgcacgccaccatgcctggctaatttttttgtatttttagtagagacggagtttcaccgtgttagccaggatggtctcaatctcctgacctcgtgatccacccacctcggcctcacatctacatttttaaagaaaacaccagatcaaacaaaaaataaaaatagttgacgtgagtgggtaacccaaagtatgctaaggttactcagaatttttgaaaatctggtttaagaattctcctgtatctgaatatcccaaatggttcataaatataagtaaatagcttctgtcacacagtattcttgaggttctttatctctctggtttggattggttcccatgttggttatgtattgagagataacatccagaggtgaaaacatactctactgagtagtgttgacataaaattaacgaaaattgttggagaaaatcagcttttggtgaatgtctgagcagaaaatctgggctttgagccctaggtaaacttactttcccacaccccacttccatagagtagacatattggaatagcctaaaatatctatctctaaaatggtacctttgaaacattctaaatttattatttcattctttcatcctcacccttaaaattttcattccaactctgcatcactggcttttaaaagttctccaatgccggccaggtgcggtggctcatgcctgtaatcccagcactctgggaggctaaagcgggttgatcacaaggtcaagagatcaagaccgtcctggccaacgtggtgaaaccctatctctactaaaaatacaaaaattagctgggcgtggtggtgcatgcctgtagtcccagctactcaggaggctgaggcaggagaatcgcttgaacctgggaggcagaggttgcagtgagatgagattccgccactgcactccagcctgggtgacagagtgagactctgtctcaaaaaaaaaaaaaaaaaaaaaagttttccaatgcctcaagaaactcctaatggtattctcaacttataaagaaggaccaatctctagaactatagacttctgaaaaggaaaatgaaagaacaatctttcttccttctttcttctctcttttcctttttcttactcttctttctgtcctttcctttcttctctccctccttcccttcctttctggtatacttcctttctcccttccttcctcctttcttcttttattcatttttctttatttcctctctctttttgaacttttctactcatttcttttctacctttatgtagtgaaaatgcaaatttgctcacatcacaattcagacatgcaataaaaatgtagcctgcttatttcatcatcataatctcccctcctgttacttttcaaaaaagatttaaactaaacttaatctacaagtttgaaacttactttgatctaataatttaaaaaccttttgatttttttttaccctatgatatttacttttagattcctccattttctccagtctcttttctgatttaggtgcatgaggaaaaagctaatggctttggaaggaaattttctcctggcctcatagtgctttttggtagtgttctggctagtagccactgaagtacagttggtccgtcatgttttaggcactctactgggttttctgcttgctcctgaattactcctatgtccaattatcctctcctgactcagagtcacataaattcttcctgctgacccagccacccttagctctcactgggatgaatatctctctgaaattctctcatagtctccatttggactgaagcttctgctttgggagcatcttacctataccactggcataataacaggtctgttgactttcaattcagtgttcatgccacaaagaaaggaggggaattgggtactacataatctttcattctacagagcaaagacttggggatatatataagctacttcctctttcttactccttctctccttcttttactaacctttggcccaaaagaagcagattttgttttcctctctggtctagatgaaacatctccctaaatcattcatacttcatgaagtagcatctacgtaaatcatactgatacatcatgaagtagcaactaccttcccatttcctcctattgtctttatttagaatgtagtgctaggagaaataaaaatgtcttactatcaaggaacttaaatttagaagtagttagaaatatattatcacttctgtttctggctattagaaagtagtggtggctagaattattcccttatcatacatgctagaagactggacaaaagatagaaaacaaacatttttaatcattggctaatatgcagtaggactgtggttcctgtaaaaagggaaacaaatgaagtaagccctggaatcacgcaggctttctactgggaggcaatttctagaatgcttcatagggaagggcagctcaaggattaagagtaatcttgctgagtagctaagacagagattgcagtttatgaggccaaagtggttaaaatgtatatagttaagagagtacctgagaggagtgaacttaacaaagaacaagtaccagaaatctgcaaagggtttccttaaaattcttgactgatctaggcttagagtgaaaacttcaggcttatataaagaacttctggacaaagaagttactggggaatttcatgccagatgattcctgaacacatcattttagttcccaccagccatagtggaggggctttattgaatactggaggcattcactagagatcccagaattttcatatcttagaagttaggctaaattagctctgaagaaaatactactccagagtcaccctgaaaagcataaaaacaacttcaaagggaccaaacaaatctgcaaatagtctaacttcctgccacaagaaaaggtagcactcttcaaagaagtataaaaaatacactacttacaaatgtaacattctcaaaaaatactatatgtacaaagaagtagaaaatggggactcataactgggtgaatatcagccaatataaacagatccagagattaaaaagatgataaaattagcagacaaagacattaagtatacttttgtaaataagcttcataagttcaagtattgaaaataaagcataaatataatgaggagagaaatgaaatataagataaaaaagaaaagcaaatggaacttctagttgtaaaaacatatctgaaattaaatcccataggatgagaacaataatacttcagaaaaaatagtagtgaaaatgaagatataacaatagaaactatctaaaatgaagcagagaaagaaaaggagactgaaaaatatgaacagaactttattgaccttttggaaagcatcaaggagtttaaaattcatgtgactgaaatctaagaaagggatctgaagaggcaatggctgaaaaaattttaagtttgatgaaaaccatcaacccatcaatctaaaaagttcagtgagctcaaaagaagataaatataaagccacataaggaaatatcatgatcaaatttttaaaagcaaatattatagaaacagtgaaataaactaaacaacaacaacaacaaaaacttattattctatacccagataaactatctttcaaaattgagggtaaaataaaaccatctttagacaaaacaaaaagctgagaatatttgttactagcaaacctatgctataagtaatgtgacaggctggatacagtggttcgtgcctataatcccagtactttgggaggttgaggtgagaagatcacttgagcccaggagtttgagatcagactgggcaacatagtgagaccctgtttctaaaataaggaaagtaagaaagaatgaaaggaagaaaagaaagaaatgttataggaagttctttaggcctaaggaaaatgagccccaactactggtattcacatctttgtgtagtttcttcccacattgcatcatgtttggtctgtctaaccaaggaaatatggctgatgtgatggtatgtcacttccgagattaggttataaaagacaagtctttctatgcctctgtttctgcctgtctcttctcattaatcactctgcgagaagccaattgtgatgttataagaagactcaggcaacctacgaaaaggcccacattgtaagaaactgtggtttcagccaacaggcatgtgaatgagcttggaaatgaattctccagccacagatgacttcatccctaatgggctgatatggtttggctctgtgttctcacccaaatttcatcttgtagcttccataattcccacatgttgtagaagggacctgatgggagatgactgaatcacgagggtgggtcttttccatgctgttcttgtgatagtgaatgggtctcatgacatatgatggttttaaaaacaggagtttctctacacaagaactctttttgcctgctgccatccacataagatgtgactttctcctccttgcttcccaccataattgtgaggccttcccacccatgtggaactacaagtccaataaacctctttcttcagtaaattgtccagtctcgggtatgtctttatcagcagtgtgaaaacggactaataaatgggcagtatgactacaacctcttgagacaccctgaccagtacatccatctaagctctcttggatctctgactgaaaaaaaaaaacaaaactgtaagatagtaagtatttgttgctataagatgctatgttttgggggcatttgttatgcagctatagataactaacatactttcaaattaattctacaaggcaacattatccagaaataaaatacacccaatattcttataaaaaagattcaaaatatttaataaatactagcaaatcaaatagagcaatatataaaatgtattacagtatgactaagtgagttctaccccagaaatgtaagtttatctattaatcaaaatgacacaacaaaatttactgtatttacagggtaaaaaacaaacaccaaaactaaaggattacctcaatagaggcagagtaagcatttgaataaactcaatatgtattaagatacaaacctctcagagccctagaagtagagggagcttttaacctgataaaaagcaagcaagcaagtgacaataacaacaaaaacttttgttaactcatatttaattgtgaaggactgactgcattttccatgaaatcagagagaaggcaaggttctttacttcttcactttttttttttgaaatggagtttcactgttgttgcccaagctacagtgcaatggcatgatcttggctcactgcaacccctgcctcccaggttcaagcgattctcctgcctcagcctcctgagtagctgggattataggtgtgcaccagcatgcccggtcaattttttgtatttttagtagaaacagggtttcaccatgttagccaggctggtctagaactcctgacctcaggtgatccgcccgccttggcctcccaaagtgctgggattacaggcatgagccaccgcatccagccctggttctttgctttcataatttctattcagcattatactggaagtcctatgcaatgaaataacacaagaattcaaacttataaaaaaataaaaattgcctttattttcaggcaagatttagaagaaaccataggagtaaatatttgctattgggaatagtgaaaaaaagttcttaaataagacacaaaaaagtataaaccatgaaagtaaatattagtaaatatacttcatggaatttaaacatttctgctcttcacaatatattcttacaaatttgaagggcaagctatggactatgagaaaatattttcaataggtacgtctaacaaaggacttgtatctagaatatatatataagaacatttacagcttaaaaataagaagataaactgctcaataaatattggcaaaaaattttagcagacactttacaaaagaagacacaaatgaccaataagcttatggaaacatgttaagcatcattagacatcatgaaaatacaaattaaaaccatagtgagatgccactgcacaaccattacaacggctatgattttaaaaaatgattttaagttttggtgagaagtgcaacaactggaaactcaaatgttgctaatgggaatgcacaatattttggaaaagtttggcaatttcttataatgttcaacaaatgcttacaatatgatccagaaattccactcctacgtggttaccctagagaaatgtaaacgtctgtccacacaaagatttttacttgaatggtcccagcagctttattcataataactgataacataatataagtgaaatgacctaaatattcattaattggtgaatggataagaaaagtgtggcatatttttttttttttgtaatttcatttttatttatttttattttttttttttaatttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtggtattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactgaaacaaatttacaagaagtgtggcatattaatacaatagaatattattctgcaaataaaaatgaaccaactactgatatgcacaacataatgaatgcattattctaagtgaaagaagccagagtcagaagactacacactatgattaaaattttgtgaaattttagaaaaggcaaaactatagtgacagaaacagataaatcactgccaagagcctgagggagtggagaaggaatttattgcagagacaagggtattttttgcagtgatagaaatgctctatattattactattgtagttgtggttacatacatttgtctaaactcattgaaatatgcactcaatcttggtaagttttattgcatgtaaacatacctcagtgaagctgacttttaaacgttatacacttgttgagtgatacaattttgaacgtcactgtacaactaatagaaaacaaagttatggcctaaaatgggccattttttcaaccaatatagatttatcacttattatgtgccaaaggctagtctagttattcaagacaaagtgatgaactagacagtgagtgaaataggtgagtaaacaggaaatttaaaaaataaagaaacagtgtaactgatatgataatggtaatcacaatgctatggattcagagagaagaggtacccaactcagccttggggccaggaaaggtagtattagagtggaaaacagatggaagaatatgtaaaagggatgggggtgtgggaaatgatacaaggagtgggtaatgtataccttgaacttggagtgagagagcagagggtggcctgtgagtaaacctgaagttagacatgagtaggcttattcaacgtacagttgagaaacggaatttggagaatttaataattgttacatgtgaaaactgaggcaaagaaggaggacaaggatgttattacttttctaaattgattaactgggaaaattatggcactattcattgaaattgaaatacatgagcaaagaaatgggcttagtgaaaggctgggggagaagaagggagacgttataaatattgaatataaagtacctttgagatatcccagcgcagtctgtaaaagaccattgaaataaagcctggagcacagaaaactgacttgagatagagatacaggtttgggtaaatgaactcattgaaatcatcacaaaagagcatgagatcaaccggagagatggggaaacacgaaacaggaaggcccaagatggtcgaagtttgtgaccgtcaaacatcatggtgtagccataaaataagtacttagtaaaaagtattgttattaccattacaattctggctgtaggtgacgttaaagccccaaaacaaagcatcatgctacctctacatgctaatgggatgtagccactagagaagggatataagtggagtgacattcttctgaacatcaaaaaggatgagatccagagtatgggatccagtttttggtaagataaaggacattcctttcggtctatcaggagcgtggaaggaagtaatgagtgaagatgcaaatacgtgtgtaacttttatgacacaaagttgagggagctttgactgatggcttttgtttttttctgtggagtcaaggtcatacggagactaagggagagaggtgggagtcataggtttgagagcaaagaagacagtttgaaatatgctgcctcagaaaaggggaaagtacttcccatagaaacataatagatccctgggcattattaaggacctagttaaggttgaggaccatgaattaagagcatttccaattgagagcgatttttttttttctttccacaattactcagcaacccaactgcaaggttgagaaaatagcaagttgagtttattcaggtttgaagttttacagatgactcataataagataattacaacttaagaaattaaagattttgaagacagtaattaatgtgattatcaataaaatcttagctagataatgagagaagtggaaacaggggagtcctgagaagtaaggagaaagtaaaggagtcggtaaactggaagttcctagaaggcctataaaatagtatattggggatcagtgaattgggataatgtggccaaagtgaagaaattgagaccataggggatgaagagggcaaggaatctgcaaagctaggttgttgaaaggatcacccaatgccgaaatcaccaataatagcaatgcctgtggtgggagaagatggaaaggcagaggccaatcttcagagaatttagaggattggccaggacataaagtcttttgatcaagtgctaaggagtaccccaaggtggaatcacaggcaaacactttcagtaagtgggaactgtatggaaggagtgaggaaatctaatccagaagtggtgatacaagccgggagaacacggactcccaaccttcagtgacatgggaggtgggaggaggaacatcctccccatgagtggtctattgtgtggcttgaataagtggggtttatggagagtttcctggctcaatgttgctgatatgcataggaggaatagagtctttttggtgattggagacccttcaggatggatgagggagcagacagcctggtggtgaaggtgatgagctctgctgcattctccaccaatgtcagtggccattctctcagtctgagcagtagtgaagtaattaaagctctagcatcagtcaggcctgggtggagcccaggttctgctcatcactcactgcatgtgggaccttctttgaattccaggttcttcaactgcaaaatgaggataatattatttacctcaggattgttttaaaactccaataaagtgttcaaaaaaaaagtttatggctgggcgcagtggctcacgcctgtaatcccagcactttgggaagccaagacgggtggatcacgaggtcaggagatcgagaccatcctggctaacacggtgcaaacccatctctactaacaatacaaaaaattagctgggcatagtggtgggctcctgtaatcccagctactcaggaggctgaggcaggagaatggcgtgaacccgggaggcggaggctgcagtgaaccaagatcgcaccactgtactccagcctgggcgactgaccaagactccatctcaaaaaaaaaaaaaaaaaaaaaaaaagtttatgataggtcagacagcattgtgtagttataaaatgtttattaaggggtattgttgttactactatttcaactctgagtacagatgattttggagcccaaaaataaagtattatgcttaatgagataaactttcacttaatctggatgatgaaggtaaaagtatactagtttgccaaatgaaaaagatgaaattctttagataatgagacctttatttctcaagatagatctttaaacaatgtaaaatgtcaaagaacctaatcatcagagttatttttctaccttcttcaataatgggtctggaaatacagaatgatttaacttttcctgtgttgacaagagcaaagtgtttggaaaggggagctgggggagagaactgtaaggccctgaactctttacaatgccccagccctggttatgcagtctgccgaattttgatgagagagctgtattcctgtaagagacatcatcgtccagatgtagatgcactgccgtgatgtccaaataggaaacaaagaccacttggaagtggatactttcctgaacttactgctctgatgaggggcccttcttttgaagcaaaatgagtcttcatgtagctgagaactctcttctcctatcactttacaaactctatcttcccccaaaggcctttccaaaggaagcagccaggctcagtggccatgatgttttcctgaaggtatgggagatagattatccagttaaaaacacagttatttccctaaacctgacttaacctctgcatataactgcctggagcctattcaacgcagttgacaattgcctgccccggggcctccctctgtcctgaaattacccatttaaatcttcctattttttttaatccctaatagtctgtggcctactttttgttgtttacgttttgtatgtttttcaaaaccccaaagatttgcttcaaattctactcattcatttattttgtaaataaatgcattcattcaatgttgtcgtgagttgggagggagaaatgtctgactgttcatttttctgccaaatgattatatagaacttaatagtatgcattatgaatcagactgcttgggattgaatcacaggtctgccactatctatgtgaccttgagtaagttgtttaacctctctgcacctcagttcccatctgtgaaatggggatataataataacttcatggagttgttgtgaggattaaattaattcataaatacaaagtacttaaaacggtgcctggtgcagcttaagagctatagacaactttgctattatttatctagtgatcttagcatgccccattagaatggaaaggggtggagcttcataaatctttttgaagtgagatcttcaagacatggatgctgatagatgccagactatcatggatgcgagtctcagcatctgatgggataagaacatggtttatcatttttgatcctgaatttgaataggtaagagatgagtaatgagaaaaaagaagggaggaaaagaagtctgcaaaatagagactgagaccgggcaatataaagggtttgtaaagcatcttgatagtgagatgtctggaggagatttctaaacgggttctgttctgctctttgatagttgttttgttggtggctatagagatttttttttccccctgaagctcctctccccattattgtgtgaagttcactcttcttgcaaatgtgagtggagtttttagaaattcaaagcaatagttgaattttttctccagctaagtcttctagactaaaacagagatacccatctagaaacaaatattgagagacaagaggtgctgggttttctgaaaatttgccaaagtactggagaagatgtctacaggctgcacagttggggaggataagaagctaattttgctgagatctcaaaggtcagcgagaccctagataaaatctaaaccaacatttactagaagcagctgtgtagtagtcatttcccagaggtctgagaattaagacctatcactagcccttctgtgttatgttagcgagtaaccatgttacgtgcctagtttagggtaggatgatattgatgggtggagaagtcagagaagggtctgctcctctccttgattcatccactcaccctcttgctttgaacttctccaaatggctgaggttttagactttacactggtggaatttcatatacaatcacataataggcacataaaatatatttcatctaatctttctaacagccccaagaggcagatcatactgtcttttcaaaaaaaaaataacagtaaggtgaggagattcatagttataggtgtgaacgggctttaggatctgataagccgaaactggattgattgatagctttgcctggtcctatctgtaggtccttgagcaaagtatctaacttctaggagcttatattttctctgaacaaggagatcttgaaggattgtgtaacagttacaacagagtgccagttgttggaaaatacctacaaaatggtggtgttactattttcttattcttttgcacttttttttatatccatagatagtaaatgctcaacaattcagtgatgaaattaagtgaaattatcttcctaaactaggctactatagtcctgttaactcctgcgtgtagtttacaatgaatccttgtgtcccttgtatggaaaaatctgcttaatttatcagctctgccaagttcttacaaaaacaaaagaaaaggtgaagaagcagaaaaacaaatggaagatatcctttctgtagtcttttactgttgacatagatttcctctgcagaagagaaaactatggctttaaaactgggatgattcatactcaaaaagaatcagagctggtctggtatgagttggttatggactgaaagggttaggttatgtcaaaacttttcatgagctagtacaagcaggattctcttgtttattgttatattttaaaagacattccaggtaataaagaaagaaactccctcagcatgttctggctttgggcccctgtctcggtcatgttggtgcggcaatggagtgggtgtctatctcccagatgtgtaagtgcagaatgggttgcaacctggattcttgattgagaaaccttctgttcctctatagatgaaggtctatttccttcctcctgaggcttaaatggggaggcatggaaagcctcacacaggactgacctggataaaagggtctttgtgaagagaaggcaatttatcaactgcagggccatttcagggaatgatttaactgtggtcactgtgctgttcacagcaactttacatccacacctatagccccaactttgccatcaatttgcaaacacatacctgatggacacctatgctgatctgatgttttggggggctttctcttgggttccaagtatttaattttattgcatttgaggaactaggaaggagggaggaaaacgtttaaaaagagagacatttttagggaatttagccaatgttccaaagagccatgttgatgaaatggagcagtttaagtgaaaacaaattgagtttggaaaaaaaaaaaaaatttcctccacccagtggcatttggagcttccattctgagttacttctaacttcctggagccacgtttactttgctgagcagactaaatcatttaagttgtcagcttctccctgtccttgccagacctcactcaaggaatgcttccagggccatgggagctcacaaaggcctcagtctgcctgagtcactctctggggaccacatatccacagggcaagtttctctgtcctaatttaaggcttctcaaagtcaggggagagcctttctgtttccatccacaaaataggtcagaaggatatgataatagcgataggtagaattttatttagcgttccttgtgtgtagcaagtaccatgttgagagctttatattcattaattaataaactcttcacaaccatctgatatgggaagctaataatcttctggttttatagacattcttttttctgagaatcagaacaaacaacttgatcaagattatgcagcagcattgggcttcaaaaccaggtggtttgtcttaaacttagctcctaatactcagctctatttctctggggacattggatgttattgcagttccccaccatgcagctcactcagcaccagggtatgtgctgtatggggtgaggagagggggaggagaagggacagctgtgattcaattagcacaggtctctgctaattgcagagaaggagcctaaattctagaggggagacaagtgtatgaacaaaatcatcagagcagagtgacagagtgtctagaagtactaaagagggcttagtacaaagtctagatgtactaaggaggaatgagcaattaggtctttctctgagtaaggaaggggctttgtaaaggaagacttgaagagaagatcatccttggacaagaacttcagcatagaagaagtttatctaaaacatgattgacaacgagaccagcaggggcaaaaacacagagagatgtggacgagaatggtgtggcagataaatagaaggagcctagaattgctctagtgtcaactgaaaggtaatagaatgctaatcagtatctattttttttgcctcctttgtaattaggtgaagcagtattctgatttcatttctggatgatagaataggacaggaaattatatgcccatctaccaagtctggctcatcaacccttcaataactgatccttttcctttctccccatattctggcagacaaagagaactcagaacccaaaggacccacaggaccaaagaaaacaaggtctctgaattattgccccaggcaatcacccctctctcagtggacacacttttattgtgttatgctgataaaatttggggattattcattctagtgcttagtctacctttactaatcatggtggttgggaaaggaaaatgatcactcagagccttatacatggaatgaagaggttaggatttatctttaaggagattgagagctattgcacagttttaagcaacagagtggttcagatctgtggctcaggatgtttgttctgaatgctgtgttgtctgaatgggttggcgctagatggtgggaatgggagacatgagtggctaatggtctatctgcgctgctctcaagggtatgcctaactcctactccatctgcgctgctctcaagggtatgcctaactccatcattttattcaatttttgtacactgtggacattgcatacagtggcataaatggataaatgacttcatcactaccaatgattttatgccagtcatggagcttggcattgacgtgcatcatctcctttaaaacttgccagaactcaggagataaatatcatgattctcctctaacaggtgaggaaacagaagcttggtcagtttgggcaacttcctcaaagacctgcagtctttaaattcttgagctgaggcttgtactcaggcttctgattccagagtttatactcttttcattaacctgcttgctgagtaacttttttgtttgtttgtttgtttgttttcagatggagtttcactcttgtcgcccaggatggagtacaatggcatgatcttggctcactgcaacctctgcttccagggttcaagtgattctcctgcctcagcctcctgagtaggtgggcttataggtgcccgccatgatgcccagctaatttttgtttcattagtacaaatagggtttcactatgtcggccaggcttgtctcgaattcctgacctcaggtgatctgcccgcctcggcctcccaaagtgctgggattacaggtgtgaaccaccgtgcccggtttgagtaacctttaagtaagaaagtgccttttgggttgagtttaacaatttccatggtagagagtctcttctgctatatgctgtttacttagcttctgcctagtatatgcagcagcagaaaatggtttcccttgttgtaggtctaatgagatttagaacactttgggtcctcagatatagtgagcaagattttcacttcatagatgaaggaactgcagcctaaagaattgggaagaaaaggtttatccaggcttgctgtgcattccttcctttctctgggaattcccttggagaagaaatctggctgatcaaatctccttgtaaacatgctgtgaagactctggggaaaaccactaatgatatttgttagtggcagtctttatctttgagagacttttagcagcatgaaccttacccccgtagtagaattgtatatggtaaacaaacctggaatctaaggattcatgggtaatggcttcttgaaaagtgtcaagtaagctatgtaactatggcaggagatggaactacttcagggttaaaaaagctggctttcatttcgtgcaagtaatgtacttgtgtacatcttttggagaaccatatgttaaatccgaatcagaccaagtcctaatgtcgtaagaaaagggctgtggagtagtattggcagtcctgggcttttccctatgttccctgtaccttgtgattacttatagctttgacattattagtaaagtttgatacttggtaaaatattttattcttgtgggtctaatttgaaaatctagcccttgtgttatctccaacagatactgcctgatccaagatcacaaagttgggcagcaatgaaagatctaatctcagacctcttctctcctgtatcccaaaccagtgcaacaatgaggtttcctctgttcctacatatttatttctacatcttcttacgtggtttagaatgatgatgatgatgatgatgatgataatgataaaatcagcaactacctttaatttaccttactatgtgtcagacatagtgcttctcattatataaaaacagtataagcaacacatctatatgtaaaaactctcacgtcgtgaaacatatgtatagagaccctatcgggttaaaccttatgaaacttctaatatgtatttaacctacaaaacaggaatgtcatttggctcaatccaatataatatgccaggtagtttaaattaggtggacaagaaaggcctctgaagatctgagatcgaacaacgggaacttggcatataaaagttcagaaaagagaagaacctatgcaaagggaatcttctgcttcaaggactctgaggatgggaccaggtgcagtttgagcactgagagtcctgttatggctgaagtagagtgagtaagacagagtggtacaggttgagttgggatgggtagacagaaataagaccattgagctttggaagtaggagtaaagagtttgagttttatactaaatgggttttgactggggacagagaggaaaaaatgagatgtgattgattgattgataatttattatttttatagatttagggggtgcaagtgcaaatttgctacatggatgtactgcattgtggtgaagtctgggcttttcgtgtactcatcacccaaattgtgaacactgtaccatataggtaatttttcaaccctcatcctcctcttgccctcccacattctggagtctccaatgtctagtcttccacactgtacgtccatatttacccattgtttagctcccatgtactcatcacccaattagtgaacactgtaccatataggtaatttttcaacccttatccccttcttgccctcccaccttccggagtctccagtgtctagtcttccacactgtatgtccatgtgtacccattgtttagctcccacatactcatcgcccaattaatgaacactgtaccatataggtagtttttcaaccttcatccccctcttgccctcccaccttctggagtctccaatgtcttgtcttccacactgtatgtccatgggtacccattgtttagctcccacgtataagtgagaacatatagtacctgactttttgtttctgagtcatttcacttaggataatgacctctagctccataattttatttttaaagagtttctctagctgccaagtggagaatgggctatagggctataaaagcggcagcaaggagactatgtgggctgttactgtagtgggcaaggcaacagccaatgaaggcccagactagagtgatagcaattggatggagataactctgcagatgaggggtttatttttgttgcttgtgacaggcaagttcccatgctccctggtagccaccttatgaaaggtcttgttgatgtttcagagaacatttacaaacaacatctcagacaaggctgtggaaacaaacaaggggtttcactcacttactttgatgtctgacttgtggatacaatactgtaagttaatcctctcctttgtctcagagaagggtttgctttgggtagcttagagcacttgacaggaggcattttgtagcagccctattacccaaggggtataggaaaagctacagaccagaactgatatgctcttctctagaaaatgaaactgcttccagatccagagataattagacaaatgtctcactgctgcagggagcaagaaagaagggctacgatgggcagattcttggcatagctcttcaggatgtacaaggacttgcccagtgaccaggagagtaggggccactgaggaaaacaggctaaattaattgaatgatggggagaaggatgaggaggagaggaaagggagattggaatctgggactgcgcccaggctgcctttgtatgcgagttccctaacaacgctttctgagggaagtcagggactgactgaagcttaattcagattctctgaatgtgccttaaggagacagactgaggaatggtctgatgaaatgcaggggaagcaaaacttggcaagggcacagtggcaaatgagctgagaatatggggggagatcctgccaagacccccttccccccaggaccacccttggtgtatccggagaaatcaatcaattggacgggaatggatggctcccacaggacagcagtgggggacccctgtgagagctgggggtcttccatttacagacaggatttgggcctcaacagagcattaagatgggtcagtgcaggcataggggacgccctgaaagtcttgtcatatcctgtggatgactcaatggtgccaaaagctatgcccattcctggactgtgcccagggaaattatagtcttgcctcccacttcgtgtgaaggccctggggcaggaagcgtgacatggttccaatatccctacactgggggcatttgtaagagccttgtagagagttcacaaaaatcattaagtctacaaaacatcccttcctgatgccacctctttcctctcttgggtatttgtagtattctcctctaaatatctagctggatacattcgtgcccccacttaggcagccaaatcttcattcactcccttctggggtcgtctgccagatttgttgaaattaaaagttggaaataacttgatatatgtaaacttcctcctgcacctcctatcaattttataaccaaatgtaagaaaagcttttataatatccaaagagctttacccaatatatctctgcatctcactcaaagtttgtgaagtagctattattatccccaactgacttgtgaaaaacaggctcagagaagcagaggcctgcccaaagtcacactgtaaatgtcctgaaacagaggggcctggaacccaggtctcctagtttctatccagcctactcacccctgtacaatgctaccttcattatcttactttttattccactatgtcaatgggtaaaacagaataaaataatattcccttgttcccatgtctacctaaatgtggatgcagtctctagtatgctttccttgaactcagtggagacaatctttcatctggaaaaaattcattttttaaggtttccagtctcattgactgccctctccaacctcatactttctgatccaacactactactcataatgatttaaataaaccccaaactgttatttcacactactgcatgtttctttgttaaggctcttttccctattccaattgtccttctctttgaatagaaaacttctatccttcctcaagccctagaaatctacccttgacctccaagtaagtcaaatgggttgtctgatcccatatcccctctctatatgtacctcatcatagcactcactgggctctcttagaattgtctctttaaatgcctggcctcttcctctggcccagaagccacttggggacagggactttctatctccagcatctaatgcagaatttgaccaataattgcaggtgcttgggaaacatttattgccttgatcagaaatcacaaactgacaaatagtttctagttattaaataatcatttatcactcccagaaataatgccattggaactttcttataatcttgcatacaataaaatatacagattctaagtattcagttagatgagttttcacatttatatgcatctggggaaccaccacctcaaagaagttatagacatgttttttttgttgttgtttgttttccttgcttccagcccacaagagcagtctgttaaacaccttggccaaggctaagaatgtcagttttaaattaatatctgaatatgagctgcctcctacaagtataaaccttggcccaagggcccacaagggccacagccaattggcagggtcatggtaaatgatgcaaaggatggcatcactcttttcaggagaaatagcatggttggcgatgtatcattaactgaatgacattttgtatctctttcattcgtggtcactgatctgtgcaaaaccctccttcccttgctctaagcagagaagccccaaagaatctaaatcagccagggacaggtaagtaagcccagggtcttaaatcacccataagtttgtggccaggtttgcatttggtcctgaaggatgtattttcctttcatgggttgtgggccaatgtttcttttcctgctgatttatagcctcctataaattaacaggagcctttcaactgggaacgccacatcccaaaggcatgaatcttccgtaggtaattcctccctgaggaagaaagagttagctctcaattacatacagcgatgggggtgcatggtggctgaaatgatacaaatgccacttatattcaagttggagccttttcacaaagtcacagaaagacacagtgagatttgagtcccagaagcataaaagtcccagagaaaggggccttgacatagctttacttgcattgaatacagatttgttcaacccccatgagaggagaaatactgaaacaccggaaaacattgtctcctctcataacattttcagctcatggtgaagacggacacatccataactatactaccagctaacatttcccactcatttggaaattatttttaccaatattttagtgactcaagcattcagggtcataataaaaggggaaaatgtactaaatcacaatttttactgagtctgatattcaatttctttgattcatttcttctttatttaatcaaatattcaccaagtattactaggtaccagacatcatgccagggactagaaataatgtgaaaaaaaaggatgttttctgctctcacggggttcacagctgtggtggctgaggaactgtggtctctgctccccaccaattatacatcagctggacataagtaagtgtgcagtaaaacagaaatttaaattttgaggtagaaaatttacttatgaattctatcactcttaaatatatatattttgtattgagggaggagaaagtggattacagtttcaaagaggcataactaggagtcaggaagcctggcgtctattcccaaatccttttctcattagctggtgatttataaaagtcatttaaactcagtcccagttctgtcatatgtacaattgtgtaaggcttaccctggaagttataaattctatgtgtttttgatcggaatccttcactgtacaatttatttgttctcttatacattcaccacttattcattcattctgctaaataaacattcatttgtcccatgtgttaattttaatggctactataacaaattacacaaatttggtggcctaaaacatgagaaatgtatcctttcccaattattggagaccaagagtccaaaatcagtattactgggctgaaatcaagttgtcagtaggatgtgttactttagggtgctctaggggatagtgtgttccttgcccctttgattttttagtggctgtctttattttttggctggtggctgcattactccaatctctgcccctgtaatcacattgcttcctcttctgagtgtgaaatctccctttgcctccttcttataaggatatatgtgattacatttagggtctacctagataatccaggataaacttttcacctgaaaaattttaattaatcattcctgcaaaatctcatttttgcaacatgagataatgaatagccacagaatccaagcatgaggatgtcttgtgcagggacattattcagcctaccacttcctttatttatgtgtatgccactttctcctccctcaacatgaattatatatatatatatatatatatatatatatatatataatttaagaatgatataatttataagtaaattttctacctcaaaatttaattttctattttactccacattttgagaatgagtaaagtataccggttaataatacagactttggaatcaaaagagttttgtcctgagtactgtctctgccacttcttatctgtgatcttgggaaaagtacttgcattataataatatgtgtcacattaaattacatatgtaaattatttagtacagttagttcataatattaactaatcagtggatatcagaaaatatcaatattaggtatatatgtggtctagatttggaggaacttgtccacgcccctggcaaattcaagatatggttaagaaattgtgaaataaacagttccaatgaaattcagtaacttttttttttaagagatggaacctcgctctgtcactcaggctgaagtgtggtggattatcatatgtggcttactgcagcttcgaacttgcagactcaagcaatccttctgcctcagtctctggagtacctgggactacaggcatacacaaccacacctggctaatttttttttaatttttatttttgtagagacaggatcttgttattttgcctaggcaagtttcaaacacctggcctcaagcaaacctcccccacttggcatctcaaactgtgggaattatagatgtgagccaccatgcctagcctaagttcagtaacttctattagcaaggaaatgtcagggattttctttgttttctttctttttttaatttttattttattttttggagtggaggtttaaaaagcagaagaaagagaaagaaaaacagttctctattgagagagatgggatttctgagaggaaagacggctggtggcagatgcgccagatttacagtcaggtttgaggaggtggtgtctgatttacatagggctcacaggcttccctgaactataaaatttcctgcacattttatagaatgtgagggtagagagggtaggagatatgacggtcacggacaggaaaggaggaaattaggatagaaaagttgaagaccctgttgctgacacccatcgggtggtcaaaggctggggtcagtccagaagcctttggatagcaccagggggtagcctcagccagaaatcctcgtttgctacaggacctcttccagccccagatgatggctaagtactctgtgaaaggaagctggttcaaacatggccaatatgcccaggaacccatgggcaccgggggattctccatgttgtcctcagcaagcctgtcccccagatttgaagattctgtgggtagaaacagtggtaattggatgctgaatgtgaagaaaagagagaagttctagataatccctatcatttttcccaaatggtggagtgaaatgaggtcactcgttagacagagaacccaggcagaatggcaaaaattccataaagaataattatatttcctctttccttttaaagaaatccaaaagtcctcttccttctccccttccacatttcccttctcctttccttctcctcctctctctcctccttctctttcttcttttcttctgtgtagctggcagcattggtataagccaacaggaaaaagtgagacaaatctcagactcgacagaatgtgtcttttcctgtctcttccccaaacagctttctagatgccaagctctttcctacctggtggtcatcttgctgccaattgatctctttctgaaaggcttgtgtctaactacccccacccatgaacaccctctgcacacacaagacacagacatttaacctgctgatgtcctactcattatttaggctgtgtttaattgacatgttctaaggaaagtattcactatttttaagcattgactctccacctcactaccatgaaaatacacacacacacacacacacacacacacacacacacagtttatgctctgttatatactgctctgattttctgtatctttcactttttgcactatcacaactataataaaatatttgaattactatctatataatgcccttctctcccattagtccataagcaccaagagacaaaatccatgtctgctttcctcactgtggtatcttttgaacttatcacagaacctggaaaataccaagttataaacatattctgaatgaaataatacaaacgaatcaatgaatgaatgatggataaatgcagtgtactataataatgatgtaaggaaccacttctaagcacacagaaagcataagacaaatgttcaagacacacatgcacctgtaaaatgagtctctgatcaggatagctgctccaatcatgggacattagacacttggtcttcctgagaattactcattggtaagcactttacagtttatgagcttctctcacttgcattatctcacatgatccacccagcagtattgaattggaagaattatcagttccaattgcaaatgaaaaaaaaaagaaaaaggcccatggagacattgtaatgacccaaggtgtcacagagactgagtgggaagggttagcattttttttttttctttttgagatggagtctcgctctgttcacccaggctggagtgcagtggcaagatctcggctcaatgcaaggtgcgccttctgggttcacgccattctcctgcctcagcctcccgagtagttgggactccaggcgcccgccaccacgcctggctaatttttttgtatttttagtagggacagagtttcaccatgttagccaggagggtctcgatctcctgacctcatgatctgcccacctcagcctcccaaagtgctgggattacaggtgtgagccaccgcgcctggccagggttagcatttaaatccatgtttttaattctgaagacatttttctccataccttgatgtccttcagacagataggcatttactaagcaccgactctgctatgtgccagggatatgcagataaaattgattctctgtatggacgcaaatagataaatagacagaatgggtccatacctagtgtggaaggagttgcaaggagtgggcaacttagtcggttctaggactggctcgaagtctggaaccagaggacacagagccaggcaggggcagcacctcccttacagacagggctaatccctggcaagtcagggctgtggagtgcttggggaatgacctcagagacagacagggagggccctggtcttgcctgcttagctgccgacagtcccagatcctaaggtggcccagtaacagcagggggacagggggacctgccctcggtcctcaattttttcatggtccttgcctcccttccaagcccctctactatcctggcaccatttcttcctgggcacctaacgcagacctcatcctctgtcctctttagtttttattaaagagacagctgatgaggacttagagtgctacccctgcagaggaacagagaagggaggtgtgtggtgagaagaggtttggtcaatgtgtgatttttcttgcaatgcccctttatcaacctgaggtaagggcactttgggtactttggtttgggttgagaagataatttgggatatgttgggtgaatgatttgaaatgaagcagtcagaccatttaagaacacgggctttggaatcagagatctgagttcaaatatgagtttcactgcttcacttcctgattatgccacctcaggcaggttacttgacattgctgtgtctcacttttatcatttgcatctgcaaaataattgtcctaaaaaccaattcatagagttggctcaaggacacagctggtaccaagtgaatgatggtcatacatgtatgtgtgtgtgcatgtgtgtgtgtgtgtgtgtgagagagagagagacagagaaagggagggaggaagagagtgtgtgtttttgcatatgacttagcatttattgagtacttctttggtagaaactatgctaattgtcatgtgtatatgattatctgatacagattttattaaacccattttacagatgagaaaaatggaagctcagacaacttaagtaatttgactcaggtcaaatggctagaaagtgcagacccaggatttgagatttaaatcaggtttcttgatgccaaagcacctgcgtatgggtagtctttctaatacacagcaaagtggaagctgtctctcttgaccttgagccactccttgcggcaaagtttccagttaacatgaaacccaatcagattccccaaaatagcagcctgttcctctagggagaagaggagccccacccaaagcttgctccagagtcttggaggaaagaaaaaggagggagcagagagtcttgcttaaaaatgtgacacatattttccaggagctgcctccaggcctgggatggagattctgagcatcatgattttaaactttttacttaatttttcattcttgcttcaggactgggcaagctggactctcgagtcttgaacaaaaatggaaaaataagggctgcagttgaaatcatttcactgtgcctatttcacatgatgctgcctgcaaaaaatatagcaaacaagattcctctgttcagtttatctccagaaagagggaacctgcatggagaaactgtaaggagtgagagagaggtttcggagaaagatgagctttagctttgcaaaggtgggatttgttttgcacagtaaatttctggaattatttcatttgatttcccattgtttgagtgtactgggtggtacaccttgtgctaggcactggaggagctcttagaggatttaaagagtcataatctctaagtgatatgagtagtggggtttgttcaaagaagagaactagcaaagagcagggcataatgaactaactataggtcaattttctcctctttcaagtcctagtttaaacacagaatacaaaatatgtctttcaaaatgatcatctttcactaaaggaagctgattaaatgtacaggtgcagcctctagaccttcctcacatgcttttctctagctggaagcagagcaatgcaatttacatgggcactgtgatcaattcttaacatggggattgtgaagcactcaaagagacttgattggattaaagactgataaatctttcctttaagttttctgaaaatgataaaaagaaaacaaacaaacaaaaaaaagaaataaaatctactccatcttccgtgaacgtggaaatagctataaccctgaaccacagactttgatatattcctacttagcaccacgaaatcttgttatggacctgaaactgggtgcagattttcctagaagtgccacaatcctcaaaagaccattcagtggtcctttgattaaagtagaagaatttaaaattgtggcaagccatggaagaagagagataatgctataaaaaaccactggtctggagatggacgctatatcatgatatttgtaactgattgtgatttagcccacctagatggtcactgcatctctggggaaaagaaaggtggaggatgacatgaaaatagcgttcaccgaatgacaagccagaaggcttgtgtatacagagatagcatggaagccaaactgatcttccaaatacctaaaccagaaagaattgacagctgcatgcaggaatggaagggttaaatttgataaaagtgttctggaaaacaaacttgcaataaaaatgaatactgcctttaaagaacttccctccatctttgacttctgcactcctcactctgcacaatattgtttagtaaatactttgtcatgttaaaaagaattatgagcaagaaataagaacagaagtttatgcatagacactgaataagcaaagcaatgaaaagcaaacaaaagaacacacatcactggaggaagagttctagcaaatagttttccagttcctgacagcttcaagaacattaggtcaccctgatatctcttttgcataaaaaagggagctctgagctaaaaagcaagagttctagtttaaaaaaaaggaaaaaaaaaaaaaaaaaaagaaggtgagaagagctcaagaaataatcaaagaagaaattttaagtaatattgaagtggaagacacatgaaaattccagaagtagaatgaactcaactgaaaacatagtcaaggacaaagctgtgcttgagaacaatcacattagaaaatgttttatgagatgaaaataatttaacagaaagaaacatcatcatattacatgccaagaaatttttatatagaatcaacagcacagatcccagtaaatttaatacatttcagatgtgataataataatgtaataataataataaagtaatttagaaggaaaaaattcagagttgccttatactcctccacagcaacatgtaatagcagaagacagtggcataatatccataatgtttaaagggaagaaaactagacccattatacccagcatagcttgtctttagaagatgaagacaaaggatctacaacctcagacatacagatattcatcctatggcatgcataaatcttccttagaattaaaaaaacagacacaagacaaagaaatgcacccaatgaagaaatgaaaaaggaaaaataaaaacttagagaagtctaggaaaaagattgattggtagtgaacattaaatccatttaagtatataactaagattactagctctgagtattactattacctagtagaataaaatattataaaacttgacaataaaaataatactgtaaataagaaaacagggaaatcaagaattcaagagatactatgtgcatggtgcgatcttggctcactgcaacctctgcctcctgggttcaagcgattctcctgcctcagcctcctgggtagctgggattacaggtgtgtgccaccatgcctggctaattttttttttttttttttttgtatttttagtagagatggggtttcaccatgttggtcaggctggtctcgaactcctgacctcgtgatctgcccacctcagcctccaaaatgctgggattacaggcgtgagccaccatgcctggcctataatttttaaaaatatcttcaatctaattttttaaaataacattttctgccttgaactttagaggagattttcataagtgaaatctatttgtgtaaggaaacttaaataaatttttcagttactcctttagtttcatgttaggctctactttataatacattcaagacaagtgaaaataatcctttacattttaagtgggctgcattggacgactctgctttcattgaggggatatgtataggtaatgattagtttaaagaagacatatctgtgattttttttcttaatcaaatttgtatctgttttaagaagtgcacatgatggaatcaagtgggcaatctctcagaagccataggagatgtgttaataaaatagtagaatagggatcaaatagaattagattgaaattaaaatctatgaaggtgaagaagaaaaaagaataatgaataaaagatgaggaaatgaggaaagatgtactgtgccttaggactactgaataccataataagccatgctcagtagtaaaagagaatgtcataggaagtgtgtattacaactgtgagccctacacagctcaacacttatacttggtaggcttcttataacatctgatactaatacgccctttgcattaaaaataaaagttttttgtacaattaaccttctcaaatgtcatcaacaagtcatcaggactgatgtttaaccaaatctgcttctaccttttgaaattaagatcagctatattattctctcaagagttttatcattagactctggacttggatgtctatcccactcatggttatagactctgtgaagaatatatattgtgtaatttttgcatgtttatttactatccttcagaatctggcatagtacttggcatgtagtagtgcttaataagtgtttgtgaattgagttaacaagtatttgtgaatgatatgtgtatgaagattaagccctcttcccaaggtgcacctaggaaggggaacatcacacaccagggcctgtcatggggtgggggagcaggggagggataacattaggagatatacctaatgtaaatgatgagttaatgggtgcagcacaccaacatggcacatgtatacatatataacaaacctgcgcattgtgcacatgtaccctagaacttaaagtataataaaaaaaggaaaaaaaaataaaaaaatatatagtgccaactactgttatattctagagtgacccatgcagaatatgcagaggatgagcttaaagattatgtgaccaatagcccaatattcacctggaggatataaaatgaatgaaaagaagatttcactcacttcagtgagtgagtgaagctttaaggagactggaaactgtaggcagtggctgacgctggcttcctctctgttaaagcctaataagaaaaactgtgcctggtatttgctctggtaatagatgatgagggagagttctactgaaaaatacctgctcttccagagtgcattggagcataggatatatacttctaatgggtcagatggtggtcacttggaaagagctgcccaggagtcatccaaaagaggttgtaatttttcccaagagagatttctggatgggtgatgagaccccagtagaaagtatcaatgaggtcaccagaggccaaagggaaattgtagggagtccaccacaggatactggaagtgggacaccctgaggtgatggaggaatgtccatgaaggacttataaacacatcttcaaaaagcttcagatttgaacatccatggaacccagactcagattttagatcccattatgcccaatggaaaccaatactagatgattatattagcattgaaaaaggaacactgtgatggttaataatgagtgtcaacttgattgaattgaaggatgcaaagtattgttcctaagtgtgtctgtgagggtgttgccaaaggagattaatatttgagtcagtggactgggagaggcagacccaccctcaatctgagtggccatcatctaatcagctgcctgcgaggatagaataaagcaggcagaagaacgtggaaggatttgacttgctaagtcttccagctttcatctttctcctgtgctggatgcttcctgcccttgaacgttggcctcgatgttcttcagcttttggactcttagagttacaccagtggtttgccaggggctcttgggcctttggccacacattgaagggtgctctgttggctttcatactttgaggttttgggacttggactggcttcctttcccctcagcttgcagatggccctattgtgggacctcaccttgtgattgtgtgagtaaatactccttaataaactccccttcatatatactatctatcctattacttctgtacttctagagaaccctgactaatacagagacctttcctgccctttatttcccctcagtgttccagtgaaatcctgaggagccagaggcagcttcctgaatgggtgaagggataacagccctcacaaggaaaaagagagaaaggcagccatgtccctgtgtttctcccatttttaaaaccatcagatctcatgagactcactcactatcatgagaacagcacagaaaagacccgcccccatggtttaatcatctttcactgggtccctcccacaacacatgagaattatgtgagctacaagatgagatttgggtggggacatacagccaaaccatatcattctcccctgacacctcccaaatatcatgtcttcagatttcaaaaccaattatgccttcccaacagtccctcaaagtcttaactcatttcagcattaactcaaaagtccacagtccaaagtcttatctacgacaaggcaagtctctttggcctatgagcccgtaaaatcaaaagcaagttagttacttcctagatgcaatgggggtacaggcattgggtaaatacagccattccaaatggggaaaattggccaaaacaaagaggctactggccccatgcaagtttgaaaaccagcagggcaatcaaatcttaaagctcccaaatgatctcttttagctccatgtctcacatccaggtcacactgatgcaacaggtaggctcccatggtcttgggcagctctgcccctgtggcttttcagggtacagcctccctcccagctgctttcatgggctggtgttgagtgtctgtggcttttccaggcaaacggtgcaagctgtcagtggatctgccattctggggtctggaggatggtgaccttctcctcaaggctccactaggtggtgccccagtagggactctgtgtgggggctccaaccccacacttcccttccgcactgccctagcagaggttctccatgagctccctgcttctgcagcaaacttctgcctggacatccaggcatttccatacatcctgaaatttagatggaggttcccaaacctcagttcttcacttctgtgcactgacaggctcagcaccacttggaagctgccaaggcttgaggcttacacactctgaagccatagcccaagctctacattggcccctttcagctgtggctggggtggctgggatgcagggcaccaagtcccaaggttgcacacagcactgggaccctgggtccagcccatgagaccatgtttttctcctaggcttccgggtctgtgatgggatgggctgccatgaagacctctgacatgccctggatgcattttacccatggtcttggggattaacattcagctcctcattacttatgcaaatttctgcagctggcttgaatttctccttagaaaaatgggattttcttttctatcgcattgtctggctgcaaaatttccaaacttttatgctctgtttcccttataaaactgaatgcctttaacagcacccaagtgacctcttgcatgcttttctgcttagagatttcttctgccagatactctaaatcatctctctcaagttcaaagttctacaaatctctagggtaggggcaaaatgccaccagtctctttgctaaaacatagcaagattcacctttgctccggttcccaacaagttccttatttccatctgagaccacctcagtgtggcccttattgttcacatcactatcagcatttttgtcaaagccattgaacaagtttctaggaggttccaacctttcccatatttccctgtcttcttctgagccttccaaactgttccaacctctgcctgttacctatttccaaagtcgcttccgcatttcaggtctcttttcagcagtgctccactctactggtaccaatttagtgtattagtccatttttgtgctgctgataaagacatacccaagactgggcaatttacataagaaagaggtttaactggacttacagtttcatgtggctggggaagtctctgaatcatggcagaaggcaagaaggagcaagtcccatcttatgtggatggcagcaagcaaaagataacttgcgcagggaaactcccatttttaaaaccatcagatctcctgagacccactcactatcatgagaacagcatgggaaagatccaacctcatgatttactcatcttccattgggtccctcccacaacacgtgggaattatgggagctacaagatgagatttgggtggggacacagagccaaaccatatcatcatctttaaggagacattattaagtttatgataaaggctctgataaaatgcccatgcttggagatgaagtagccttaaaaaattgattgcaacttaattcgctcactagcacaagagtgtcctttgtaaaactgagcagaaatcagctcctagaaataatgaatgtttatcaattaattggattgatgatttcttatcagacctttctctggttggattatttactctagacactccactgtttgttaatgtattgctaagattgctatgatcatattaaatcccaagtttattcctcaagggattttatatctgttttgtttgtctaagaactgtgacctcacttgagtcatttaaacaattcatatttctgcctttcctttaataatctttctcttagtcatccctgataaatttgggcttgtttgcttttcaacattctgcttttgatgcatcccatgacactcaagcagagcagttttctagaaatttagaacagagggctagacttcatgggcaatgttagtaatacagcaattttctgtatgttattaatttagagatagatatattttaagatagtaagtgaatagagaaggaaaaaggagcacggaaggaagactaaacttgaaaaagaggaatgaagcagctaaacagatgatcaataataatgattccagttaatggcaagtttcattaattaagtaattactaggttccaggccctgcaaattgttttatccacattatattatgtaattctcaatacaacagtaaggtatattcttttcctcatgttaccaaggaaactgaggcttggagatgttaaatcacttgctacaggtcatacagcttttaaatcacaaagaaaattaatcgcaaagaaacttagtttcttttcaacttcgcagtctattacatctttaaccactgtgctctgttgcctcttaagtatgagaataaaccagtagttcttcacttggagtgattttacccccagaagatatttggcaatgtctggagacattttggttgtcacagcttctgggtgggaggaaaaaggggtgctactggcgtctactgggtaaaggccaaggatgctgtgaaacatcctacaatgcacaagacagcccctacaacaaagacatacttggctcaaaatatcaataatgctgagatcaagaatggaatgaagttactgatctttttaaaaattatatttttatctcattaatattaacactagtatgtctagagggactgaaattatacaaggaaatgagtttgctgtgcagaaagaagaggaaaaggaatatactttggagtgggacttagagccttgggaggaatttgctgaccacaaacacgtcattgttaatagtaagttctgagttaccactgcatgccagccatcctttgcatgggtggtttggggcctacatagaaagaattggcctttgaatcaatactcaatgattgtaacagatttgcctgtctcctgtgtttttgctattctttctttatgaaaaaaattagtgtccattttaaaaggaggatctgttacctgctatatttagcgtcatgaaggaggagaactgcaatatttgctttccataaatttgcaaaaagaaagatattttccacccacccccacccatgcaatggttttccactgacagctgtatatatgggtatcctgccatatatctctggagtgaagaagacctgggaggcgtgggcaggccaatgaatggagccattgactcagatgttcctcgatgggcaggcgtgattatttcagggggccagttcttccactgtgaccgcatagctgagggcacagccaatgaatgagcttcacccaataatttctggttgattcacatttgggtcagtgatgtggtgggcaatgccagctgcagccccaggctccaagggcaactttccaagctgggactccttacaattctgccctgttaatggaggttgggggaaaatctagggtgggtccctccaggcatgagtgagtgaggcgagggaaaagaaggaaatggttttcataaattattgctagagtttttagagaaataaaagcatgggtttgagaaggaggtggaggactctcagcatcatgccactcctattgctcttcggataaagttcaaattgcctcatgtggcctactaggcctgtcatgagcaggttgccatgttatctttctctctagcctccccttaggctgccgttatcttcaatatctaccctccagtcaggctgaccacgttttagtatctctaacacggcattgttctctcctcaaagtctttgcaaatgctattactttatcctggaagggcttactcttcaacccccaacctgattaaatccttctcatcattaggatatagttgggatgtaactttcttgacctcccagactagatcagattgtggttacatgtttccatagtaacttgatcttcattgcagttatttcaatagctgtgttttccatctgtcttcctcatgagtctgtgagctataggagggccagaaaatatctaccttagtttatcttccatacctagtacctagtccagcgcctggcccgtagcaggttttactgaatatagtacttaataaaaaataataagggggagaaagaaggagagaagaaaagaagggagggaaggaaggaggacaggagcaaggaaggatacatggaagaaaggaagaggggaaagaagtagaagaaagaaagaagaaaggggataatttaatttgtaaaacaaaaacaatttccaatcatcagtttcaacctctggacttatctgtaaggtgatggcagaattgaagtctaaaatctaagtctcctgaatctcagttcaatagaacaaacaaataagtacaatagatccagatataattcagagagaggtcaattatccttgcaacttggaggaagtatacgagtttgctgtttctcagtgaaagccaattccctgtcgtggcctattgagcagccacatgttctatctgttgctattatttggagtatgattagaggcaccaggaaaataattagaaacatcaagagaaagattaggtgcatcagaagaatgagtaggggcattagcattgatcaagcaggaactctatgccaaggactatgcagggcacatgaaacacattttctcatggcatcctcacaaaccacacactgaggtgaggattgttccccgcagtgaggctaatgagaaaatcaagactcagagagtttcagggtatatgaggagaaagaataataccctggagacctggatgctttggtcacttattccctttccccaccccaggcctacctgatgacttttacttacacttcacatttgattcaaatgtcactttttcaggaggcattttctttttttcttttttttaattttactttatgttctggggtacatgtgcagaacgtgcagttttgttacataggtgtacatgtgccatggtggtttgctgcacccatcaacccatcacctgcattaagtatttctcctaatgctatccctcccctagctccccaccccccaacaggccccggtgtgtgttgttcccctccctgtgtccatgtattctcattgttcaactcccacttatgagtgagaacatgcagtgtttggttttctgttcttgtgatagtttgctgagaatgatggtttccagcttggaggggatttcttaccaccctcactaggtcaactcctctcttacagacctccatttcctctttgtacttgtcacttctaatcatgcatttttgagtgattagttgactagtatctgaatgcaaggcacatgtctgcattggtttgccgttgttttcccagctcctgaatagccctggcacataacaggttgccaataaccacttatgagcaaatgagttagatcattttgttgagcacatattctgtcctgggccctgtgctgattgatcttgctgtgtacagtggaaagtcatacatggtcactgctttcaaggagctcatagtcccatggggagattgtcttatttttttatgatattactatgttattttttaaagatactactttaaaaaataagagagttaaaatgttattggtaatagggggcccagggaagtccctgggtggagagaaggcagagatagttcattttacctaggaatgggtttctagaggagagggagcttggtgggagcccaggaaagtgaaaaggtgtttttcaggtggacaagggtgatatgtagttaggcagaaggaaatacagatgaagggagaaatatgagcagagggaaaagaaaaggagatgtgaaacaacatccatagcaaatggtttggtttacctggagcacctgctttgttcagaggcatgtccaagattgcagttgaagaggtgtctgtgggttagatcaggaagtggttttcatgcttgccttgggaaattgaactcttaatagtaaccacatgttgatggctaaacacagttaaaaggatattgaaccattcatccattatttgagtaaacatttattgggtacttacgtgctagcacgctgaaaaatgtgggtagaaataatacaaattccctcctccaagaagcctgcagtctatcaaatatgtaacagcagtcaggccctgacttctacgttaacttgtaagacacaaaaacaaaaatgaagcaaactgaaagcaatcggtcatcttctactcagcatacccagagtgggctgatagtgacagagtaggcaatgatgagggatgtgaggaaaggaggaattactgtgaagggaggatacataactccaggagctcttcctggagaaagtggctcagaggataaattctgcaatgcaaagagaagaatatgttttcaatgcacacatttttatgttcttaaatatctgttgcatttcccccccacgactcaggtctaaaaaagcttcccatctctgacattaagtgaccactccaactttatagtcctcccacatcctccacctaactaacctttcttgaacacctacattttgccaggcacttttataagcatttagttatagtattccatttacccactaacttgtaagatctgtttcataaacaccatcttgcagatgagacaactgaaaccagaaagtgttaggttgctgcaaaagtaattgtggttttgcattattggaatttgccatttgatattgaaatacattcttaaataaatgtggttatgttatacatcattttaatgggcatttcttgcttttattttttgctaatgacattacttgctgtttattttatgtttattttagactgtagaaatgatgttagacaaaaagcaaattcgagcaatttttttatacaagtttaaaatggtcataaagcagcacagacggttcacaacatcaacagcacatttggcccaggaactgctaacaaacgtacagtgcaatgatggttcaagaagttttgcaaaggagacaagagctttgatgatgaggagcatagtggctggccattggaagttggcaatggccagttgagagcaatcattgaagctgatcctcttacaactacatgagaatttgccaaagaactcaatattgaccattctacagtcactcagcatttgaagtaaattggaaaggttaaaaaacttgctaagtgggccgggcgtggtggctcacgcctgtaatcccagcacgttgggaggccgaggcgggcggatcacgaggtcaggagatcgagaccattctggctaacaggatgaaaccccatctctactaaaaatacaaaaaattagccgggcgcggtggtgggcgcctgtagtcccagctacttgggaggctgaggcaggagaatggcgtgaacccgggaggcggagcttgcagtgagccgagatcgcgccaccgcactccagcctgggcgacagagcgagactccggctcaaaaacaaacaaacaaacaaacaaacaaacaaaaaaaaaacaaaaattgctaagtgggtgcctcatgagctgagtgaaaattaaaaaatagtcatttttgaagtgccgtcttctcttattctacgcaacaaaccatttctcaattagattgtgacatgtgatgaaacgtggattttataccacaaccagtgaagactagctcagtggtttgactgagaagaagctccaaagcacttctcaaagccaaacttgcaccaaaaaaaaaatcatggtcaccagttggtggccggctgccagtctgatccactacagctttcttaatctgggtgaaagtattacatctgagaagtatgctcagcaaatcgatgagatgcaccaaaaactgcaacacctgcagccggcattggtcaacagaaagggtccaattctctacaacacctgactgcatgtcgaataaccagtacttcaaaatttgaacaaattggcccatgaagattcgcctcatccaccatattcacctgacctctcaccaaccgattaccacttcttcaagcagctcaacaacttttgcagggaaaacgcttccacaaccagcaagatgcagaaaaatgctttccaagagtttattgaatcccaaagcatagatttctactctacaggaataagcaaacttattcctcattggcaaaaatatgtctattgtaatggttcctattttgattaataaagatgtgtttgaccctagctataatgatttaaaattcgtggtccaaaaccacagttctttttgtaccaaccaatacagcaaaaatgtgttttcataaatgttctacaacaaaatctaagaactttccagtatattgtatggtataacacactttctagttcagatgtctgcaaactaaaaaaaaatgtgatgatcaaaaccattgaatgctagcaaagggattacccaatacttgtcatctcacagctattcattattgccaggaagttctcagacttcatgcaaaccttaccccctcatctttcacattaggaaactgaggcccagggaaattcagcactggctcagtgtgatggagagtgtttgtagccaggccagaagtgagatccaggtttatagttcctcttcttatgatcttctcactaacgtttatagttctaatgctagattctgattcttctcattttatgttctccttgcagtttgtaaggtgtgttgggaagggtataggttttgaagccatttggatctcggtccaggttagagatctaccactgatttactctgtggccaagaacgagcttcctcctgggtttcaatgtcctgtcaaatggggtaaaacaatctctctctagtaggtttgtgataagtgttaaaaaaagtcacgtatagagtaactaggacagagttcaacatataatccgacctaatacatgttcgtttttcaacttcccttgctaggagatggaaggaaggtgaaatctgccacgatcgctactttcaaagaatgtgaactctctttgctccctgcaccccaacaaagatttctctcttatcactgtgactgtgttatcagagggggataacatagtggttggaaacacttcctcagactggagagactggctaggatttgaagaatgcctccctagggtctctatgtcagtaacactttatgttcaccagtggagcacaccagttactttctggatagataaaacaattccattacttacctgtgcacaaaatgatttccgtctttgtcagggctgaggtgctagttttatgacataagggaggactctgattcgagactgctctttagtctcttatttcaaagatagtttttttctgagaaatggcaggattggagtgcgccttttcatggaagttcttttctctgaaataatggaaatttgtaagtccctataggaatggagtggctgaacttccagatctgaatttcactgaagatgtttctgacagacgtgtcccttcaatggtaatcttgccttcactagagatttgagaaaagaatgaagcatgttttgcattttgaaaatagaaaccatggcaccccatctctctctctctctctctctctctctctctctctctctctccctctgtgtgtgtgtgtgtgtgtgtgtcttttaccttgcctgcatctcctttttttattttttaaaaataaatatttttgttttattttgttttataaataaaagttttatttataaaaagtttactttataaaactttttataagttttatttataaaaataaaatgttataatttctatgtgtgcaaaaaaatgtatgcacctgtattctttatttccagtggaaaatggcaagattcagacagtttcccagatgtctccaaacctacttgttctagaatcatgtaacacaatatatatagacacaagtaatatctattttttttcttttcatgtacttctaacagtccacttttaagtgctcccatgaggcttttcttgatttgctttatttttcttttaaataaaatcttaagctgcccactccagtgatgaggtactacctagtcctagtaagagattgcagtgggatcgaatgggacaaaaacaaagaccatgaagcagtaagtacttcctaattattcaaagaaggcatgtggagcacttgccatgtggcagacacagtgctgggagctgaaattagaacagggggaaaaaagaaaagacatactacttgcccatacagtgctagcttcttagaaatttttggctgaatttatgaatgagagtattttttcatttataaaatgtaaataaaagcaaccatgtactagggcagttgtgagagttaaattacatgtatgcatgaatatgagtaaatatggcaaactggttaggaggtcaggctctgaagtcagaatgcctgagtttgaatcccagatctaagcactgaactctttttgcctcaagtttctcttcagtgaagtgagtgatatggtttggctttgtgtcctcacccaaatctcatctctaattgtaatctccatgtgttgagggagggacctgtaatcctcatgtgttgagggagggaggtgattggatcatgggggcagtttcccccatgctgttcttatgatagtgagtgagttctcgtgagatctggtggttttataagtgtttgacatttcctcctacacacattatctctttcacctgccaccatgtaagatgtgcctgcttctccgtctgtcatggttgtaagtttcctgagacctccccatgtggaactgtgactcaattaaacctctttcctttataaattacccagtctctagtagtacctttatagcggtgtgagaacgaactaatacagtgaggaaaatgctattagttgctgtaaggaaaaaatgagataatttatgaaaagcacttagtgctaagcacagagtaaatgctcaataatggtagttcttgggtacatagtagatgctcagttagattttgttactaattcactgaagccagaagacagaattttgcaatgtaagtagaactgaacgtgtttttatatgtgtagcttttctaagataattatgtttgagaggtgttgtttccagtagaactctttaaatattattacacagctcttgggaacttgggaaaattttactcattattccaatacatctccctgaagactgatttccaccccccacaagtttccatgttcttcatgggtctggaatttagtcagagagacaggctacttttctctaacccaagccttctccttgggtgattaagcacgtagtttcatgggaagtttaagaccaaagaattatggcattgtcatgtcaggcactcaagtgtcagggatttggcttaagtgaattgattactggaaacccttgaaacttgttatctttaagttgcttccagcccctgtgaccagaaatgcatggcgactcccaataacatctgcctttcttacaatcccgcccataccagttcaaagatcacatagctgattcttttattaataaaatatttattgagctcacacagcaccctaagcactctgctaagtgctcaagatttagacaggaataaagtattatctctgctatcatgactgttatcttgcagtgaagggttagataaggagacaggaaatgtcaatagattataacaaatgggacagtggcacagggacatgtctgggacacataagcaaggttcctgcctcctctttggggccagattacatttagtgatgactgtgagaaaaatgtgtcagctgaactgaggtctgaaggcagggtaaatgtaagccaggcaaagtggacatgggatattaggatatatttctgccgaagtaacaacatataaagacctaggaattagcaaaagcgtagcacatacaggaaactgtaaagaatgcacaaagtcttgtatacaaagttggacatagtgagagttgagggtggaaaagcaaaccaaaggcaaatcttgtccaaggaatttgaactagctgagtgcttggaacattggtacatctttgttgaaagactaaatggatcaataaactgtattctgagggaaatgaagagccattaattcatttaaattagcatctgacttgtgttatatgatcatagaatctaggttaaataattcacctggtgcctcatatgagagcttgacataggaggaacaatcttcctctgtgttgcaatcaccatagcatgaacaaaatgggaatatgggggaaacaggagaaggagacaaatagaagagcagtcatcccagggaacagactaaatacggaaggcctatgcccagcccaaagaaatgcagagatggacaagtcatctcgcatggataagcaagcattcatcccagggaacagactaaataaggaaggcctatgcccagcccaaagaaatgcagagatggacaagtcatctcgcatggataggcaatagaatggaatgtgtgtatttaagccccagagacaatggcgttccaaccttgcctttgtccctaccacctatggactttcatctttttgagactaagtttctttatagggaagatgtgatttttaacatccctgcgtggagttgttgtgaatatataatagctttatgtataatgcatttatatataaaattctcagcacagggctatatacttcttctgggatactcagaaaagatcatttaagataagaagccatcctaaatttggatgttttctaatataccactgagaataactatatttattgaatgcttatattgtgttatgtgctgttctaagatttatagtgaccgtggatttaatcctgccaaagaccctataagatagtgaattctgttattctcactttacaaagaagaaaacagaagcctggtggaaatatgtatgaatttgcatgaagatgtatggccagaggtggtggagttgggactcaaacccaggctgtctgggattgaaatgctttcctatattgctgaaaaaaaaaaaaatggctgtacagtaaataaaatatcacagtgtcatgtatgaagtcagtggttctggcaaccctgatctaatgctgcagtggtcataaactgaactcagggaagttggaagttgagttttgaaacaactttaaatcatcttatttagccccttaatactcacatcagaaataatcttattttgtgtacattgttagacaattaccaataacctaactacggttttgtctaagacactgatttgacttagttgtctggaagatttagttgtctggaaatacattgtgatattgcataaacttttaaaaaatctagttaagtatcgccttttacacacaaagaaaaacagttttgtttaaggtgaagagacttgctgaaatgtttgtaatcagtccatgaaactgatttcctaacaaagatatttggtgccatggagtttgaaaaacagggaagaattttcaggtatgatgcagtcttcatcactgaactcattgtactgtttagttatatgtaacagaaagaagtcaaacttgcttagaaaatgaaggggaatttatttatggttgtatccaaaatttcagaggtaggaggaactttatgtacagctcacatcagtgactcaagattattaccaaaagactattttgtctttttcttctttgttttctatccttttgttatcatattagaatataaggtggctatactagccagatactccaggtcaacatgcttattcacaggcagtgatcgaaagaacatcgctggggatcagtcaaaactgcctgaaatgggtatccaagaatggtagcaggtcatttctcctaaggaaatttgtggaactattatccttaagaaagggaaatggaggtaaacagtaaaccaaggtgtacactgaaatctctttctaggagaaaagagtccacattcaaaagtcccaagcattgtctgagcaatgttatgtgacttcaataaacatttgcaactttgtatttattggattcatcggtggtcacttagcatgactgaatgacctgtccataaatatctgaaggtcattctcagatcttagaggaatattaaagtgtgaatgttttatttctaagattgggaaactgatgctccaggagagaaagtaacttgtctaaattctccagacctgtaaacacaaagccggcatgagaacccactctttcttactgtctctctgaagtacatagagataaacaaaagaaatttcaactaatcatgacaagtaccaaattattcaagagattacccaaacaacttagctaattctgatggttttaaacactaaatcacaaatgaggcaagacaggagaatgtcagaggtgcacacataacatgttaggcatgcatgggagcagtagcatgtttgcgttattatttgtttacatggcttagtatctaagggacatgaagtattgtcatttatcagagactaggtctcaagtttgactctggtttaagttttccataatctgctcagtacatttcttcatttaggcagctctttcacaacggtaaaagcatcaggtgacaacttccatctggctggtcccaagttacttttcatgtaattcatccttttaataagctatctcctgacatattgggtccatcttgacaagccatgtttttttttgtgagacatcattctaattatcttaatatcttagaaggaagaactccataattatcttttatgggaaggctcgagacacacatttgaaattgtatgcccaggactttatgtgcagaagaatcaaggtatagtattatccagtgtctctggcaagtttttgggactaaatttcaggctacaagatgtttgttgttcattgcaaaggtcaggtttgactgcgtttattaaattacaaacttgcttgtcttgtatcatcggaagatggtatgaattaaggctttctcattccagtcacagtacagattgcagctgaaaaacatctaaagggattcaagtgaccaagaacattgaacagaaaaaccataacaaacagtccctgcctttggggagtccctatgctatttgatacaacagaaaatgtaccatatgttaaaatttaagacagaccaaatatcaatcccttcctccaaataaatcaagctgtcagtagataagacctcctgcctctaaacttgactcctccagttcccaccgcaatgatcccgatctcttactacttttgcaatcaaacaacttcaatagattttcattgctttaatgatcaagttcaaatgccttaaaacagtggtccccaacctttttggcaccagggaccatgtttgtggaaaacaatttttccatggactgaggggggcaggatggtttcagaatgattcaagtgcattacacttctcatgtactttatttctattattattacattgttcattaatatataattaatatataatgaaataattatacaactctccaccatgtagaatcagtgggagccttgagcttgttttcctgcaactaggtggtcccatgtggaggtgatgggagacagtgacagattctcatacagagcacgctacctagatccctcacatacacagtccacaatagcgttcgtacttctatgagaatctaatgctcaggctgtaatgcagcaagggggagtggctgtaaatacagatgaagcttcactctcttgcccactgctcacctcctgttttatggcccagttccacatggaccactatcagtctgtgggccaggggtgggggatccttcaaagatacacagtgcctcccctaccctcatctcttaatgttctttaaggcccctttttaccatcatacaaaaaatgacttaattttctgttacatgctaaacttattcacatagctaaacttttgaaaatactatttcttcagtctggaatgttctactctagtagtccaagtaataaaatcaccctttatgatgtagcttaattattgaaatctttgagaagggtgaattttatggcatatgaaatatatcttaataacgatgctattaaaaacaacaaaacattgatgactcttttataagaaacttccctctcttaactcattctaccatacagtcaggtacctgaaagcagatattaacacgtatacatgtacatgcacacgatactaggttagggaccaatttttttctcccttaaaaccctgcatacctacctattaactgtgtttataggtttacttgtttattttccatctagacttggagcctttaatgtggtagccattaatagcacgtggctgttgagctcttgaaagatggctagtccaaaatgagatatgctggaaatgtaaaattcacacacaacatttcaaagtcttgttatgaaacaatgtagactgtctcattagtagttttatagtgattacctattgaaattaatatatacattgggctaagtgaaaatgttattaaaattaatttcattttttctctttattttttaaaatgtgtctacatgaaaatttaaatttatgtatagggctcattttatttcatttggacaacactgatttagaccgtgagatacttaaaggtagggacagtgttttattcatctctgcatatagagtcaggcctgtggtaggtgctcaaggacttctctgcatgagataagtgactgaatattaagtcccaaatgaacagtgcagacactgagaacaatgggactacaagggagaggaaatgaacactatttccatacaagtccaggaaaatctgtacaagggatgcagaaggcctcgaagctggaaacgaaggccttgaagctaaattcttgagtagctaaagaagagattgtgccgtgccaggtgcggtggctcacctctgtaatcccagcactttgggaggcaaaggtgggcagatcatgaggtcaggagttggagaccagcctgaccaacatggtgaatccccgtctctactaaaaatacaaaaattagctgggtgtggtggcatgcgcctatagtcccagctaatctagaggctgaggcaggagaatcacttggacccgggaggcagaggttgcagtgagccgagatcgtgccactgcactctagcctggcaacagagcgagacttcgtctcaaaaaaaaataaaaaaaaaaagaagagattgtatgatttctccaagtcactgtcggcattcacgtttctcctatgaaaataaaaggccagcataaaatgggctttgatatgacttcataaagctgatctcatcatgaccactccaatgggaatatttattttacccttgatttggggttgctgattagcttccaaagtatgtagagggtcctgccatgcctggggtttctcttaagatattttatatacatgtggttggttcagtcgaggagaggcacaaagttaatctaaggccttctctgttcaaaactgtcaggtccacagtttttattcatggaagcttctgtaggctattctataggttggtgcaaaagtaactgcagcttttgtcagtaaaagtaatgccaaaaaactgcaatttctttcgcaccaacctaatatgtacatctgaatgggctgtaagcagacatctgcccctggcaacaaccaactgatgatttttttttttttttttttttgagacggagtctcgctctgtcacccaggctggagtgcagtggtgctatctccgctcactgcaagctccgcctcccaggttcacgccattctcctgcctcagcctcccgagtagctggaactgcaggcacctgccactgtacccggctaatttttttttttttttgtatttttagtagagacgaggtttcacggtgttagccaggatggtctcgatctcttgacctcgtgatcttcccgcctcgacctcccaaagtgctgggattacaggcgtgagccaccgtgcctggctgatgatattttataattaaattaatccattcagacagactttctgatattcagattttaaaatgcaaaagaggatagggcagttatttgcaagataaatctctctcaatagtaagtatagttttgtataatattgtataaaaacaatgctaataacaaaatgtattgaaaattcactatattggacattgaatgttatttacattacctcattcaaactccacaagaataaagtttggattgccattctacatttacagttgagttaagtggctcagaaagtggaaacaactgggccaaagtggaggaggaattagaactcaagtctgttttgctcatttttgctaccatgtgaagctatctttagggtgtcagccataagttttgatcaggttgtcctgccactgacttgataaatcagcccctcaggaaataatctacatgcagaacttccaactgattggagaaaacagaagctcagaaccctgcatttctgtcgcataccattcttagtgtagaattggaactttcaatactggaaccctgctctgagactctgcaggcctaatcatcaacgcctcctctaggtgccagccatagaaggaccacgttgggtctggcccttatttcagggaaaaggagactttctgcccagtctccaggctgctgaatcagcctctttcttcctttggctttcagaatttactttcaaccctttatttttcagtttgatggcctcacacagactgacttttgtgaattgacagagataaaagaaaataaaaacctggttatgaaccactgagtctataaactggatactttcctagatgtgtggaaaatataacagtgctagttttttttttttgttgttcctcttggactgtgagtacaaggctccttctttgagaatgagcaggaatgcctataaggagttttctttttattttccctgactccactttttgtttctggattatgatttatatcagaaaacatttcctatggtttggagatatttttagaagtctgagggtggtctcaggaaaaatggaaaatactctgttatttgtttctttatcttccaacttctctctttaggttccaatccggaccttgccctcagtcttactcctttcactgtccgagccaatcttttgtcccttgtttatttctgtagggaaacacccaatgcaggaggtgatagctctggaatttgtcattgataagccacctccttccagaaatcacaaattcattctgactgaacccttttttgctttaaatcagaggagcggtaatttctagtttgaaagtaacagacacatgtggatggtatccttgggaagaggaggaagagcagcactacagtgttattttacagacagcgtcctacctcatctatgggcacagaaaggcaagggagatccttattttatacctctatgagaaggtagtcttttagcattgcagagatcctgaaccgatagtttaggtgatatgaaacgtcaatcatacagcacccctgatgaaaaaccactgggcctagaaactttgaatacttatggtgctgaataactcattactttggaaagtttgctgttattatcttgtgcttcttatcatcaaatacgttctcagggcccattgagtgctaggaagatcttgaatcatttggagaaaatgcagcactgtgtattggtctccagacaggttatattcctggctgaggtcacaacgtctggtgcaaaactgaataatgcgagggtgatatgggattcgtaagcatttttacactcctgctaggacaagagagggttttggagatacagattcaaagacaattatacgtgaaacagcaaagtctgatagttgaggacatggcctcaggattcagagttcactacttattatctacataaagttgaccagcttacttaatctccatgagccttggtttctccatttgtaacatggggctcacagaagtatttgcttcataggggtgttgagaaaatgaaatcacttaatacatgcaaaatattgagaatactgcctggcatatagtaaaaaagagctcagtaaacttaagccattattgttatgaccctgactcaagcatgtgttgagaaatcctgaatcaagtgtagtatcatcatagaggaatggaacacttgtttgttaaatctttgcacttgcaagatttttagtggacactaagttctttacttttacagtctcatttgctcttttctaaaatcctgttgtctgggcacatcttaatgtttcccatattacagatgggagacttgcagctcaaagaggtcagacattttttcccaaggcctcagcttaaatgtcacaccttcagagatagatgccttctcaaagcactcaatataaaacagtcacccactcccgttttacatttactctaagattatcatctgcatgttattcactattagctggcatttttgtcatattcctgtgtgcgactgtgcttattttatgccttttcccagctagaacacaagctttctgaggataggaacctttcttgtcttggcacagaaccaatctccagcatttaatatgttgcaaatctttggtaaacatttgctgaaggagtaaatgaaggacactagaaggagaacagaatagaacaattattctgtaagaaaaacagaaggagctgtctttgctttccaatgctatccccaacttcatgaccttgggcaactgatttcctgtctctaaattagggaaatgagaatagtaacctctacttccttacagctatgatgaggaaaaataaaataaaatttaaaaatcacttagcatagtgcctgcgcataccaagggcaaaataaatgctggcttttgtcattggaggaggcaggatttgtgaggtttgtttgagagtctttcctgctatgttctatgcttatataggaaattatgaataataactttgatgagaacagaaaagttcaataaaaccatcatctctttgttccatttggttacttcaaatttgacaattatcttttaatggagaactgaactaaatgttctcattattttctttccagactaaatgctccttcttaaactaagtctcccaatcccacctcatatgtaactattttatttcttcccacaagctcaaggaatgtaaaaaaaaaaaaacgaatcttaagatgttaagcttagtggaaatgcaggaagggcttacaggttggttgcctggtgcaattttctgtcatgcagggaaaccaagactgagagagggaaatggattcacctcctgacacagtggacaagccaggacttgaacccaggtctctttaatacagtttctgccatgtttccctgacactcacacagagaaaacaaatctacaacagttatgtctccacttcgtaaaccttccattctccatcaccacttccaaataaagaataacggttgttacaggaatatgtcattacttgcccatttcgaattgccaaccagggactcccatttccaacatgtttatgtaaaagattaggagactctttgctctaattggtcatttttccactgagtaatagagttgcatcattgttgaattggctcagcctgacacaggcagacacactgatatatgtatgctttaatctgttaggaccaatgaggaaagaaaaccgttatttactttttgtcctgacctcaccatttagccatggctctttgagagcatacttcatttactgaacaaactgctcagtagcatcaataacttgttttagattcttttaaagaggacttcatatggcattcaatccttgattccccaataaaacaacacagctgttcccttgcagctcgtctctcagcaggagctgcaaaatcatatttaatcaactttgctttaaaagccatccagtttcctttagggctttggcgaacttccctggccaggatggcccctgctgacatgtcagcagctacagcttttccaagccctggcggagggagttgccatttgctgagcactttctcatgtgccagtccctctattgggcactttaaattcaaggttttatttaatccacatggcagtctcatgagatggggattgatctctgattttaagataaggaaactgaggcttagaagtgtaaaaacatttttcccaaatcaaagagcaacaagtgaaagaattgggattcagccaagttctctctaattccaaaatctgtgcattttctacttttcagtttggctttctacataaagaggtaccaaggaattatacaggggtgagtgagacacaatttagtcagtatgtcaaatttggcaacagagtcccattgctatagctcctaagtctttttaagacttacagctttttcttaccatgatgaaatttgctgttagaatataaataatcttgatggcatcttgtattcaataaagattaacaattattatgtacaatttactcttcaaagtgaggtgaagggatgcagagatcaaataggtatacatcttgctctcaagaagctctaagtctagaaatagagatacaacagcaacatcaaacatgctaatgaaaaatagaaagtgataagtgttatgagtgggttaaattatgatggaaatttgaaaaaggagaagtctattctagctaaggcataagtcttatccaaaactttgaatgtaaagactataagtattttccataaggctttatggaagattgcaatagtcaggatgattaacactagctcctgtgacacccccaaagtatcagtggctttaacacaacaagaatttcttcttcactctttgttggggtgaggcagtgctctcatctatgatgtcactcaggatataggcttcttgtatcatgtggctctaccctttgagagtcctatgtttctagccacctggttagagaagagagagagagagagagagacagagagggagggaatggaggatcaagtggaaagtagaggagccaggcctggaagtggtttacttcatttcatttacatctcagtggacagacaagtcacatggccccaacacaactgaaagaaggatgggaaatgtcttcttcctgtaggcccagggagaaaacagagcttaattgagcacatagcattgtttctgccacaaggaatatgaacataggtgttgcagaatcatttaatttaagaagttgagggacatgcaggatgaaggtagtgtagagggtattcatggaacactttgattcaaaagagattggtttggggtcgggcatggtggctcacgcctgtaatcccagcactttgggaggctgaggctggtggatcaccttaggtcaggagttagaggccagcctggccaacatggcaaaaccccatctctactaaaaatacaaaaattagctgggcatggtgatgtgtgcctgtaatcccagctacttgggaggctgaggcaggagaatcacttgaacccgggaggcagaggttgcagtgagccctgattgtgccactgcactccagcctcggcgacacaccgagactctgtctcaaacaaaacataaacaaacaagaaacaaaagagattggtttggaaagatagttgataccagatctggaaaggcctttagtgacaagcattttccaaaatgtatttttcagaatgttagtgagtaaaatatgaagaatgatttgagtagtcaagtagattttggaaaaactgcgttatcaaattttaattgcctcggttccacaggatttcgatttttagagggaggcacgatgtatcaattataataaaccttttcgatcacagaatctctttttggtagactatcttgtaagactaatattttgtgacatggaatcttaggcaatgaggaaccattaagcaagaaagacaaatgattagacttacttttagaagtacaagccagagatgagttccaacccacatcccagatttgaccaattaataatggctggcattagtgctatcatgaaagaaattatgaaacttcatctgaacttatctaggaaaaggtagtgattgattaataatgtctgctgtagagtaaaggatatagaggtgtgtcttagttagtttggacttctataacaaagtaccatagatgggtggcttaaagaacccacacttatttatcatatatcttccagcctcctatctggaggctggaagtctaagatgaagatccttgcaggtttgcatctggcaaaaacctgcttcctggttcatagatggccatcttctctctctgtatgctcacatagtggagaacagagagaggaaaagcaagctctctcatctctttttttttttttaaaggcactaaccttgttcaaggggattccacccttatgacctaattacctcccataggtctcacctcttaatgccatcatattggggatgagaatttcaacatatgaatttggggggaaggcaaaccttccacagcagggtgtgatggttaattttgtgtatcaatttagctaaactatggtgcccagttgtttggtgaaacagtagtttagatgttgctgtgaaagtattttgtagacacgatgaacatttacaatcagttgacttaaaataaacgatattattcttgacaatgtgtctcatccaatcagttgaaggcctgaaaaataaaactgaagtttttcagagaggaaattctgcctcaagagtaacgaggaaatcctacttgagttttcagtctgctgacctgctctgctctgtagattttgaatttctagcttactggcttgccatccaaattttagacttatcagtccctacaatcatgtaagaaaattccttaaagataagtgtgtgtgtgtgtgtgtgtgtgtgtgtatgtgtgtgtgtgtgagtgtgagtgtaggttcggtctctggagaaccctgactgatacaaggggtgacaacagcatgatggcatttgattttgttgctttaggtgaaggttgcaagttgggttacaaagagagcttgggtgcctgaaagtggtgtcaacaccaaaatggaaaagatttcaggagaagaaagttcagatttggaactttgtcctttagatgtcacctggacaaacaaatagacatccttcagaagaacgttcattcagagctaagcagaagtcagcattatttccagtgtgcaaagatattttgaagagaatgtatatctcctttaggatccttcaacagatacgccacctgtttgcctgcagcagtttcctgaggctgcaatttggaacaaatgcctctagtgacagggaacaaaaagagttgctttgtcctgaaaggaggttaagagtcatttgaggctgactattcaagacacacctgaatggggtgtgaattaagagaaaggagggccaggtgtggtggctcactcctgtaataccagcactttgggaggcctagatgggaggattgcttaagcctaggagtttgagacaagcctgggcaatatggtgagaccccatctctaaaaataaaagaaaaaggaaagaaaataaaacagaaaggaggaaaacggttatagaaaaaggagaggaacatcactaagcgaaaagctgaatggaggtgagtcactgggcatgactaagccatgactaagacctccagggtgatagatgaaggtctcaccaccaggagagtggagtaattattaatgcatgtttgcctggtgagttatttagttacaaaaaccacagcagaggctcttcattgtaacagctcaacaatcatatatagagttcccgcaatgcagacactcactaaacactggggtcacacgggggaaagacacaagtccagcctcattttgaatcagtctttttgtgtgttttagtagcttcccaaacataactttgtcttatcactcatagatgtaatgaggtagcttgattctatttattcaacaaagacttattgatttcctacaacaaaccatgcactgttcttgctatggggaatatagtagtgaagaaaattggctaaacttactccttgccttcatggagctgacattctcatgtgggtgacagaaaataccatgataaataagtaaactacacagtaggatctgtggtgatatgttagagaaaaaaaataaagcagctttatcaatcaagagaggttaggcagccaacatgcaataattaacaaactggaatctcagtgacttttccactcgcctaattttcatcgtgggccagaaggggcctctgctcccacaacgtcactgtcttccttgctctaggactctgactatagagcaacgaatatctgtgctattataggggaaaaaataaaaagagatttctgctgggtctcaccttggggaagcaatgctcagcctgaaattgatgcacattatttccacacatcattcattggaatgaactgattagttggattgacctaaaatatggaagcaggaagtacagttctatcatgtgttcagactgggggaaatcctgtaaatatggcaaacaaaaatagggtcatttaggtcacagtgaggactttggcttctcccatgagtaaaatgggaagccattggagactgtgaacagtcgagtgagtgcagaatgagacagacttttgttgagatcttggctctgtgacccagaacatgtgatctataaattggggcaacaaaacctaccttattagattggtagtaagattcactgagatatttgtgtaatgcctggcataaaataaattttggcaaaatgacaatgatatattgaatttcctataaacctatttgtttcatcaaatgaggatgaatttcccccaaagcaaaaaccatgtctaattcatcattgaattctcaattcctaatacaagattggacccacttcattcccctaatatgtgtacttcattctccacaggatggctgagaggagggaaaagatgcagagagcatctgtgtatccttgctgctaagaattcaccttttttaaaaaagggagctgtcaccttgaataaaaaaggctgaagcagcaattcataagccacagttaatgatcaaactcatggcaagtcagctttagaatccagtggaggcatgttctctgtggccttatggcttgggggactgtttggaatatggttagctgtcaccttatatttctgatataagctatgacatgcctgtagctgacacatttgtccgcagactctttgttcaaagagaaaggtataccacagttgtgctagtaatggttgcaatgcctagggatagaattacgaagaacttgaaaaatcttgctcttagcatgtgtcaccataatgaatagatcgacggtacaaggtcaaacttaatgcacaatgggaaaggtggaaattttttttattatctttctttatatgtgtctcctttcactgcatagctttttctccacactcctttcatattgatctggcaataatgctaactttggtgcattcaagaggcccctttccccaccttcattttgtcttttctctaacagcacttgtttttcatattcttgaacacattcagctagtggctgtgaatttggagagataagcatataataactatgatgatcatacttcttagtttgcccagaacagtcatggcttttgcccaatgtctaggtgtaaatattaatgataatcccttttattctcaaatttttctcagttagaaaaatatatggtcctatttattatagaaatttatccttttctgaagggccacacaatgccagaaactattatgcctttccaccagcgtgatcctagagttaactcaaagtttcacgtgttgttagaaatatgaggggtttcaaagtcaaccaaaatagctggaagggaaggacattgtcatagtccatccagggagttagcagcccactctgctgccaatctcaaccagaatttgacctccccatcaagttctgctgtcacattatcctcctctaggagaggaaagatggtggtgacaaagcactcaactttggtctcgatggacctgggtttaaactttgggtcaattaatctatgacagttactgtattagtctgttctcacactgctataaagaactgcttgagactgggtaatttagaaaggaaagaggtttaattgactggtagtacagcatggctgcagaggcctcaggaaacttagaaatcatggtagaaggcaaaggggaagcaaggcaccttcttcacaaggtggcagaagggagaatgaatgcaggaggaactaccaaacatttataaaaccatcagatcttggaagaactcactcattattacaagaacagcgtgggggaaactgcccccaagatccaattacttctacctgatttgtcccttgacatgtggggattatggggattataattcaagatgagatttgggtggggacacaaagtcaaccacatcagttacctcttaatttaaaatttttagcaggaatactaacatatgattcacccagattgttataaaatttaatcacataatgtcatataatgtgaaaaaaattatataatgtaaaaattgtttaacatagtttattgacactattgagtgacagcttttattagtattattaataaaataaaaattgaattttcatattactgcaattaccacagggtctgaaacctagtagttactatacactttttattttgaatcttgatatatacatacagcagacattgtttttcaaaacaatttctttctcattagtacagaaggaactttggatgtgggagagaaagacaaggagaaacctgaaagcagcccagttatgacaatgaatggtaagatattctcctgacctgagatctgcttttacggagtaaataaatgaatgttacatgagcccagtgcaaaacaagcagggtgtgattatgcaggcagtcttggagaagttagcaccattgtcagctctgagggatcataggagtagaacagctaccactgaaagtaaaaaggaatctgaatccagttgttgacaatgacaagtcaagttttaaaaaacctgagtagaatctgctgctattttaataatggttggatacactgagcagagcctctgacagaggtaggatgtgttaagccctggggttccctgcacagtgttgcagcagagtagtggtccctcagctgtgagctaggttaagacctgagactgaaatggatacatttaactcatgcccaccccaatcccaggcaaagcttttcaagtcttgattggtcctgcctctctgagggttttttttttttccactttaagtatatttttgaggttcagagccgtaagaacatatcatggaatttgcccacaagtgataaagtatcatctcaaatttgggcttaacttgtgttggggactcatatttgccttagggagttaaaatttttactatgtaagatagggagagagatatcaaattatggtgtatagaacatctgctttaaaatcatttggaaaactttaaaatgctgacttctgtaccttatctttgacctactgaatcagactatttgagaaatgaatatgaaggttgattagctcacagagttttactatcctcatgattattgagaaaccattaggctagtggctctatgaataggttagcataataaaagagaattatcttcatcaagatccaataatggtagttgctaccatctttatctgaccattgagaaaactgatgtaggaggagttgcaatctgccaaagacccaaaaggatatagttacaaaagaaggagattatttgtttttgtttttttgttttttttgagacagagtctcgcgctgtcgcccaggctggagtgcagtggcacgatctcggctcactgcaagctccgcctcccggggtcaggccattctcctgcctcagcctccctagtagctgggactacaggcgcctgccaccacgcccaactaatttttttgtatttttagtcgagacggggtttcactatgttagccaggatggtctcgatctcctgacctcgtgatccacccacctcggcctcccaaagtgctgggattacaggcgtgagccaccacgccctgccaaaagaaggagattatttgtctttgccatgttctaatggaagtagaggtaagatgcttactcagattcttttctccctgaatcagtgggggacatttccatggaccaaggaagagggatgatttaggccaaaaccctaattttgattatttgatgataatttatattaaaaatatgaaaaaatagtaaccaagcacaaaataattatagtaccttgaatgagtcctggtagcctctgctgtctctgatgatgtcaagaaagtcaggggcattttccaggggcaacagtaactattgccttaagtttgtattttttattcatgttaatggaattggaaaaagcttagattttcgggaaatagtaactcacaagttaccaagcagatggcaatttcctctctgcctcttgcctaaaaacacactttggatgcgtcataagcaaagcccaggcccagttaaagctctgttattcagtccggaagcagttgcttctgtatttatcatggtgctcagggtatagatatagatcttagacatttttagtgagatagtttgaggagcctgtagaggcagagaaatcagtatgaaatctgggagaaaaaaagggcattcatttttgaaacaggtataatttataggaatggacacttcaatccttttctttagaacacagttttcatctgaccagtttgcttcttgcattgcccagaaagcaatcgatcatctactcctttttttcaatgtgatcaatagagaagagtgtgctgacttagagaagagattctcaaacttcaatgcacccacaaatcacctatcttgttaaaatgcagatcgtgcttcatcaggcctgagaatctgcatttctaaccagctgtcatggctgctggtctgtggaccacactgcaagaccaggacttagagcatggtcagttgcccaagttcacttgagaccatgagaacattactgagcttctgagccttcatttcctcattttaaacatttgcatataatacagataatgaaagtgcctaacatataggactattttaagtacagaatatagtccacataaagtgctaaaataattaattgtcacatcatattctatcagtaaatgtttgctatcattattaggcatttgctgtgtgccttctatatgctagggttctaggaaaagaattagaagatgtgctttttgtttcttaaatctaacaacctagaagcggtcagtaaaataggttacatagaggcacataaatctaccatgagttagcagatagatgggtgcacgcttcaatggcaggaatactggtcatggagtaaggaagctggtttccctattcccttgtcgtaaggaattttgtgaaaacctctttcattttctggattgttgtctcatcctttataacagaggaattttacccagctgcatagttctgatggcagtgtctgctgccatcatgcctgctgcagcaggagcaagtgggagccctgccccttctgaattgggatgggagattcccgtgccactgtagctgcccaaactgcagctgcagactcaggcctccctgctctagggagcaggcaggagccccactctcctgggtggggctacagccacccaaactgcaaatgtggatctggccaccctcccaagcacaggatcggagtgtctctgcagcctgcaccctcaggtgcaccaggaaggattccccctccatccctacaggctcaggggtgtctgctcccactgcccagcctctctctgctcctgacacctccaatgtcagagcagggttggagccaagcccaggggccatgaatggcagcaggaggcagacagagtcctaggcggaagtgggtggagtccccagtaaggtcccattctcaggccagggagggcccaaaggctgggggctgggctgccagtttctccaaccagagtggcaactcatagtgcctcttctggcccacccatggccgcccatggacccattcacatgtacttcccctctctgaggtccataaaagccctggcctcagctgggtgcagtggctcgcacttgtaaccccagcactttgggaggccaagccaggtggatcagctgaggtcaggactttgagatcagcctggccaacatggtgaaactccgtctctactaaaaatacaaaaattagctgcacatggtggtgggcacctgtaatctcagctactctggaggcggaggcaggagaatctcttgattctctgtgtgggggttctgatcccacatttcccttctgcactgccctagcagaagttctccatgagagtcctgccactgcaacaaacttctgcctgggcatccaggcatttccatacatcttttgaaatctaagcagaggttcccaaaccttacttcttgacttctgtgcactggcaggctcaacaccacatggaagctaccaagacttgaggtttacaccctctgaagccacagcctgagctgtacattggcctctttcagccatggctagagtggctgggacacagggcaccaaatctctaggctgcacacagcacgcagaccctggtcccaacccaagaaaccactctttcctcctggacctctgggcctgtgatgggaggggctgccatgaaggtctctgacatggccaggagacattttcccccatggtcttggggattaacattaggctccttgctacttatgcaaatttctaaagcttgcttgaatttcttctcaaaaaatgggttttccttttctactgcatcatcaggctgcaattactccaaacatttatgctctgtttcccttttaagagaatgcttttaacagtacacaacttacttcttgaatgcttttctgcttagacatttcttttctgccagataccctaaatcatctctctcaatttcaaagttccacagatctctaggacaggggcaaaatgctgccagtctctttgctaacatataacaagagtcacctttgccccagtttccaacaagttcctcatctccatctgagaccacctcagcctagaccttattgttcatatcactatcagaatttctgtcaaagccattcagcaaatctctaggaggttcaaactttcatacatttttctgtcttctgtgagccctccaaattgttccaatctctggctgttacccagttccaaagttgctttcacatttttgggtatcttttcagcagtgctcctctctactgataccaacttactgtattagccagttttcatgctgctgataaagacacacctaagactgggaagaaaaagaggtttaattggacttatagttccacatgtctggggaggcctcaggatcatggagggaggcaaaaggcacttcttacatggtgacggcaagagaaaaatgagaaaaaagcaaaagtggaaacccctgataaacccattagattttgtgagatttattcactattatgagaacagcatagaaaagaccagcccccatgattcaattacctccccctgtgtccttcccacaacatgtgggaattctgggagatacaattcaagttgagatttgaatggggacacagccaaaccatatcagggatcttcgcaaattatcagatgaccctgataggtatatagaggccttccagaacttaacccaagtattaatatgtgaactctcctggaaggatgtagtgttactttggaatcaaaccctggccaacgctgaaaagcaggccattctcagcaagtggcaaataattttgaggaatgagctttatatcttgtatagcacgagggaaggggaggaactttatccagttggaagaatagcagtaccattggagtaccctaaatgggaccccaatgatgaaatgggagagttgaagaggaaacactttaaaatgtgtgtatattagagggctttgtaagggactgagactagacctctcaatctcactgggctacctgtggtagaccagggatttgacaggagtcccactgccttcctggaaaggctaagaggggtcttggcaaaacacacccttctctcccctcattcaatagagggatagctggtcctaggggatgagtttgttactcaggcagcctctggtatcaggaggaagctgcagaaacaggacataggaccagtagtactttagaggacctcctgaaagtggccaccttggtcttttataatagagatcaggaggccagagagagggaaaggagacagaaaaaaaagcagagagtctcatagccaccttacaggctcagaaaccccagagttcctaagatgtacttgttgacttctgcaaatgtaaaccactggaggtcagactgttcctgagacacaggtaaccaggtccagggctggtctttcaaatggtacagcaaggcttatgggtcccagggttcttttccctggctttggtgattcagactgccattatcatccaggagccttgggtgattatgggtatcaagggaaagaggatggatctcctggactcaagtgcgcctttcattctctccaacctaggtccccctctcttagcatgactgtgaggagctcaggagaagccaaaactcttagttgtcacctctttacgtcaggaccccaattcctgggactgctattcctgggacttcctttatctcccttgtttgaggaggacctggccccacagctttgcctgcttgtgatagggaggcaacagaggagtgggccctgccagttgctagatgcaatgtggcaagggtcatttgggactaatttaaagggttcatataccctcctgaggcaccttttatcccaaactttggtttgaagccctgtaatggaacactagacctaaggcagatgacagtgggagttgagggtcacagcacaggtgagcatgactaattcctgccaaataggccctcccacttcacggatggaggttatgctcatggtatagataaggtctaaggaactcacagattaccgagagtgggaggcttaggctccactcagatgagtgtgaatattcctgtcagctatgcttcccacttcatgggtgaaggttgcacttgcacccatagttggcacctgcacaagtcactgggactcagggatataaggtcaggagaagaaagagggatgccttttcttctcttcatcatgtaacctgggtggttgctgggatggtgaaaggaacaaagggatgcctttttcccctctttccagatgggtaaccaaccaatcattttcaacctgccctcctcaagtgcatcctaaatcactggacaggacttcagagctcatggctcagggaaaggaaacccagaagcctgaaatgctggcaaaagtggaaaggttcttgccattcagactgtggcttctctctttctgtgcaaactagttgcaggaatgatataaatcacttctttacttaatttatgagcaccgttttacttataagccattttggttgacacaatatacatcaataaacacaactagacatatatacccacacacaaactaagatccaatagcttggaaccctggccatgagatagcaacatgagctcactggttttactttgtttgtcccaataggtaatccaatgaaggctgtaaaccaaaatttcaggtaaaacagtttccatatcaatttgatttaaaggtcaaatctccccagaattcgaagaacactgaggccaaacagcaccaaaggagagtatcacacattaagtaaagaagtccttcagaattgttaggatacatttttgtctggattatgtttgtctactataacatctaatggagactcctgaaaatagatttacatacaagatgtaaggaaagtaaaatgtgtctttagtaaaagaatatgagaaagcatgggaatgtaaatttttgcctagttcagagggttcaaagattgttttaaatgagataagagaaaactaaaggttcaaacaagttatggaaggtttgtaaaaattttgtaaaataagtgtgtaaatatattgactaaattcaaaagggtatttggtttttccataaattgaacattggaataaatgcacaacaaggttttcttgaggatttgtctgtaaggttttattttttaaaaattggggtgaaatttggctttctcttgaacacgacttttgtacaatgaaatgtttttgtttgcaaactatcaacaaaagaagggaaggacaaaagacagattatttggaaaactaggtcttctgtcttaatgagtaaacatttttgctttttaaaataaatttgagtcatcattgtagctaaacggatgacttatggcaatctgaaattctattaagtgtttgagtctttacagcttcaaaattgcctttcctaactcccaacttttggaagctacagagggaccctggagtgtccaaagtagaggtaaacaggattatttgacatgtttagttatataggattattgaaataaggtggtgcttgatcttcaggttatattttagtgaaaaatgttaatatgtgttccaaaatagtatgagatttctggagtactgatgtctgagtctgtgttattaatcataattagggtcattgtgttaggttatcgtaaatcacagaggtgaccaaatttctttgtcaattatgtttttgactgtaactaacctaggacattttaacattcatagacaattgttgtcttgttttgatcctcttcaaagaatggattataaccctcaagtgcaggtttcttataactttgaagattgtgaacaggagttgagtaggtaaactgaactattggaagaccaatcttttttgactttttgcttttttcttggaacagtgctgatccttatgtcctgtttttcagaatcaagggtttttttgagctatttgtggctttaaacaattgtagggtgaaccaaccagtgatctctgaccacagctcagaagaaacaaaagggatgggccatcaaactccaaatggtcacaaagatggagccctggatgatggctcccttgtactggggacctttagataggacccaccgagagagagacttgactgtaggtttcccagaacaatgctccttgtcagcatgaagcagttaagagctgtcatcgtctccatcctaacagcagttaggtgtacctcttcagaggggggatggatggcattggctgccgccatcatgccagctgcagcagggaagtgcagctggggctgcacactccatggagcaattgggagacccttctgagttgggatgggagctccctgtgccactgcagctgcccaaaccacagctgcagacccaggcctcctgctctacggagctctgcccaggagggtggagcagagctccgctgcctaaactgcagctgtggatccaagcctccctgtgctcttgggggagctgggaataggcaagatctgccctctcaggtacagctgcagccgcggcataagcggctgcagacctgggcttttggctccgggaagcaggcaggaactagggacaagcgggagccttgctccttttgagttgggggcggaggtgtggtggggtggtgggagatcctgggcgcagctgcggccaccctcctaggcacaggacccaggtgtctctgcagcctgcaccctcgcacgcctcttgaaggagccctcccccacccccatccttgcaggctcaggggtgtctgctcccgctgcctaacctctttctgctcttggcacttgatacaatcttggagccgggttagagccaacctctggggccatgaatggcagtaggaggcagacagagtcgtgggtggaagggggtggggtccccagtaaggcgccaccctcaggccagagcgggcctgaaggtggggggctgggctgccagtttctcctgcctgagtggggactagtggtgcctcttccaggccctcccatgactgcccatggaccaatcagcaggcacttcctcccctctgaggtccataaaaggcctgggctcggtcagagcagggtaggggactgccagaggaggaagagagcggaggtttgagagatgaggagatgaccagctgcagagaggagcaccctctctgctgatagctggagaagatgggatgagagacctgcaaagatattccaatgacttgcctgtggagaggaaccaccctcttcagagcctcctctctgttcagagctgacgacctgcctacagagaggagctacccactcttctgagctgttctaacactaaataaaactttttttcttcacctttcagttgtctgtgtacctcattcttcctagatgcaggataaaaacttgggcaaaggtgccacagccacagagctttccagccagaaaaatggacaccccagagatcccgtaactgttccatcccccaagtcatgacttattagctttgatgaccttagtcaagtttcttgaactcccaggctttattgtcctgatttacaaagttgagataataagatgacagttgcgaggattaaacatcttagcagaaaacatttggattatcatcttgcttctttaagcactcaataaatgcaatcatcattgtcctcctcctcctcctcctttactagtcctttttccttactattttttacaaactctgtgaccttagtcacctcacattagccacgactcatcgctttctaaaatgttcaactattaatatatattggagctatttttacttttttttttgagtggtttctgaaacaatcaaaagattaaaccagaagtcaacaaactgttttctgtactagaccaaatagtaaacattttaggctttactatagacaatatagtacaatacacaaatgggcatggctgtattccaatcaaatcttatttacaaaataaaataaaataaaataaaataaaataaaggtaggtcgacaggacttagtttgctcacccctcctttaaagtaaagaagctgtaaatgttctgtgatttataaggaagtaagtttcacccaacacaaacctgtgatccatgaaatgcaacataatattgtaggaaagtcagtggctctgtgttctccagtagtcctgccttcaccttaagaaccccatagccttagaaccagtcttaccttggagaaggatcaaatctctcttttttaacagctatattaaactgtggcccagataggggaatttatttattcaaagtcagcagctccagggatagagccagcaccagaatcttgatctcctggctccaaatcagggactacatattttctctttagcttgaaaagagaaagaaatcattttcctcaggaaaaaaataacttatttccactagagttttaatatagaaatatgttttttaaaccttcttgttaatggttatgccacagtcagacatgaaaacactgctatatctgcttaatgggaataccagtcccctgtccttgtcacttggatctcatattaaagatctcctttcatttctattgagacagaaaaacaccctctccttctactcacatctagtcagattccagaatcatttctttggcagtaaatcagtagtgaatgaaaaggctactcacatctatccatatcctattcccaaagaagaaatgggaacagaaagccctggaatgaatacaagcttccttctgctaggatctgaatggaaatacttctctccttttaatataccatctgtgtagattttcatggagttccttttcttattttcctatcctggccttgctgaactctgataggataataataataacaacaataataacagttatgatttaatgagaatgtactgtttaccagcattatgccaaatatcttagtcatgtgtgagaatattctgaatcccattttatggatgaagaaattaggcacaaggagggtaagtcagacatgcaaaaagaggattatgacttcagagcagatgatttaaccctgcttagattcttcctgcaaatagcaaagaggtaaaccattttgatataaacttaacgatgtgtacctatacaattccatttatatgaaatgtccagagaaggtaaatggtcagagataaaaagtagattagtttttgcctgaagctgggagtgggaatggggagtgactgcaagggccatgaaggatattcctggagtgatgggaaagttttaaaattgggttaatattattattattctgagacagaatctcactctgttgcccaggctagagtgcagtggcatgatcacaactcactgcagcctccatctgctgggctcaggtgattctcccacctcagcctcctcagagctgggactataggcatgcatcaccatgcccagctaagtttttgtagagatggggtttcaccatatttcccaggctggtctcgaactcctgggctcaagcaacctgcccaccttggcctcccaaaagaataattgtgtgattatagacatgagtcactacacctggctttaaaatggattataataaggctgggtgtggtggctcacgcctgtaatcccagcactttgggaggccgaggtgggtggatcatgaggtcaggagatcaagaccatcctggctaacatggtgaaaccctatctctactaaaaatacaaaaaaaaaaaaaaaaaaaaaattagctgggtgtggtggcaggcacctgtaatcccatctactcgggaggctgaggcaggagaatggcatgaacctgggaggcagagcgtgcagtgagccgagattgcaccactgcactccagcctgggcaacagagcaagactccatctcaaaaaaaaaaaaaaaaaattggattataataatggttgcacaactccacaaatttgctaaagatcattgatttttctttttgcacatgagatgaatgaaacttatggtatgtaaattaagcctcaacaaagctcttaaaagattaaacacatggaacagaaattgtgaaggcttttcttagtcttcatggctgctcctcttgtgtgggcatcttcatttctctttacagccacaatcagatttgaccatagaaaggtcccttctctcccaggattgttaactaccaattctttgatgatagaatatggacagatgaggattaactgcttcctcaatgctaatttattgccaaagcaagaatcctggaatttgagtgggtgcaaatagaggaagagggtgcttcttcactttaatagaaatgagacttttattacaaatggcatatgataagaacaagggactgtttttcccattaaacaaacacaagcatattttaatatatcttaaaaaggtctctatttcaataagcgcatttatgtatttgtttatttacttgacatgcattcaccaaatccttcttatgtgccaggcacctttcctgactctggggataaaacaatgagcaacctagtcattacccttgtcttcctaaagctttcagcccagcaggaaatcttaccttcttctttccatcttcatgaaaattctacctattctcccaggctctaactctattgggaggtaacccctccaatataatccaccacatcattttttctacctctctcttatgactccagtcatgtctacattgcagtggagttatatttgtttactactaattgccagaattatctcctctacaagtctataaaatccttcctagtagatgctgtgattaattcacctgtttgtctgctgagtactcatcataatattttacacctaggagataatccataagcctctgttatatgaatttgctaatttatccatgagccacatattttagataattttcaagcaacaggtactgttctgggcactaggagatttggtggtgaacaggactagcaagatccatgtcctccaggatcttactttagctttgaggagacagtcaatgaacaaatgattagaaagacacagtgaatttggataaataaaggatattatgaaggaactaaacagagagtaacttattaggggtggactgcagggaactacttcagcaaggatagtcacagatgctctctttggggacacagtatttgatcttagacatgaaaaatgaaaaagaaccagccttatgaatagttaggtacaataatagtctaggtagagagaaaagcaagtaaaaagacccagaggcaggaaagaatttggtgtttttttaaggaaaacaggaaatcaggccagtgttgctaaagcctagtgagagagaaaaagaaaaggaataggaagataggaagaatcaaatcatgaaaggccttgcaggccacaggaaggagtgcaaatttcattctatgagcaatggatgaaggacctttaagagcaaagtgacgtatatgttatttgtagtttagtgaaatgattttgtatgatttgtagcaaacgtataatattttggggctaaagcagtgaaatcatgaataaatactttttttttttttttgagacagggtctcgctctgtcacccaggctggagtgcaatggcgtgatctcggctcactgtgccctccacctcccatgttcaagcgattctcctcatgataaatactttgaatgtaaagttccttaggcaggagtctggagacctgggtctggattatagagtgatctcagtgttatcagacatgtacatcagtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagtatatggtagatataatattcttaccagttttgttagtgttattattagtgtgtgtacgagagttagtagttgtgtaaatttattattagtgtttaaagtattttattttacattaagtgcctttgttagtattcttattatttgtgtctatattattaagtaacatggaagataaaaatactcatagctagagcatatacataggctgttgttcccttggtaaggaccaaaaactggccaagctgagagcatcttttgaaaagatggatcaggacacagtttcatcttttccagaaggtcagtcctcaggaaaccagacttgagtttgctattgctccagaggtcagctgggatgggtctgggggcctagaaacaagaccagcaaatatgctggctgggagcgagggtggcagcaggtggatgatgccaatcctggtcgactcagagtcacagcacctgcccaagtcaggaactacaattcttcataaagaacaaagaagctacattttactgggaggaaagagccactgggcttgtaaaggagaaatgaagggctgggcttagctctctgggtcaggaaggatttgtcagagaacaaaaatggtaacttgcgagacattagagaaaattatctctgagagaaagacaggctcggcctaacgtgtctttccttgtggttacattatttggtgcttgctgggtgacaaatcatccatttttatcttttatgtaactttagttttgatgttaggagctaagaataactaatacccaagagggtatgaccctggagcaaggcatgctgggaaagcacatttctgggtgcatgttgcctctgtgcctagagacatggattcaaataaaagtcacagctactgtcccaccgggggccattgctttggaaagtttaactgagcttttgaatacatctttgtttgccattcttattcaaggttatccaaagacaaatctgcttcaagagaggagaaagtagtaaatttaaatggacctttcaaacaacgttcagtctaaaaatggagaagctcaagatcaaatacgtatttgaaatcactggctaagaaacaaaattagtgttttcaatgggcatcgtttccttggtcttgctggctcagaagagcaagtgcaagggttgagaaattctgttcttgctcaattccattaatggtcaggcagttgggggaagaaagccaatcacctcccatccttttctgactatttttgttgtctagagttatgtccataagaggtcaactcgctgtggctgaaaagaagggagcgtattggatatttagttgtgaacttttgcatgcataggctgagatgggctagtcagagattaatcatacctgtggggccaatttgttcctttcaacaatcatgggagggaaccatgattattagcgtctctactttatagatgggaaaacagattcccaagaattttggtgactcacccaagaccatacaataacctagtgacagagtcagaatgtgaactggaatctccccaatgcttgactatactacaattattggaggacctaatgatcttttttatcttaccaaaaatcagaagaatgtttagtgaccaaactctgcatctggtcttatttctcttgacctctagactgaaatgttcccaatttctcctctttctgagccatatagcattgccagctggtaacttctcagtaggcttagtgagatcaaatatgtgagagttttcaaattggggtgtttcagcttcaacgaccatcatgtgcatccctggaatcccaggacactggggcatagacaaagcttaaccccatcatattatttgacataaggggaaacagattcagagagaaagaaggagttgctcatagtcacacaactgctgtgacattgcatgtccatcggtgttttccaagaactgatgaaatagatgttcaaggaagctcaaagagaagagataaggaggaaaaacattcattattaacaatctctgtcacttccttgctgtgcaatctctgataggtctcttaaactttttaattctcagctacctcctgtgttaaatagtaatcatattggaaaataccccaaaggtatatgaggattaattgattctgtgtatgtaagtctccaagcacagggcctgaccttagtagaaatcaatgcataggagctataataaggtcttatcaggtcagaagcacagagagaaggagtgggtttgtgagcttgagcgggacattgctagagggagctgagagagtgatctgaggggatgtctgtgagttcccacagagcagttcagtttgggaaaacagaggggtgaagataacaggaaaaaaaagggcatgtcctttggtaaattgcttattgttgcccagatatcactgtggtaacaaggaaagcccctgaaatcagtttgtccacagctcaagatataactccccagggttttcagtggcaagttaaggggttccaaggaggagccaggaatgaggcagtcacagatgggaacatttatttctttgagagtcttccgtttaagatgttctcagagttttggatgagctaaagggctcttcaggctagaacttggtcttggagggcagctttccttccacctggccatgtttatcttacttccattagaaggcaagatgccaactttcctattcaatgaagtgtttagattccatgaggtttgtaaatagcctctgggaactcctttctgaaacttcccataggacttctaaactctccttaatcagagcagattgcaagagcaaatgcttcttattatgggttttaaaaaggtgagtagaccatagataaaaatcatagtaaaagtgggaatttgaggaaggtctgtttgctcaggaaaattttctaaatttcaaggttataaatgaaactgtagatgatcactcaggcaggatgtggtttagtttcttcatgaccatgataatgtttttcacataaaaagataagtagtactcatagaatgatgtagagaaaatcattttgtttgaaagaataaattgttcaagcatttgtaggcagtcattcagttttaagtagctacagacaacccttatctgttcagttacagacaatccttatctgttcatggcaagtagccacatacttttcaccaatatccttttctgtagctccccagtgaagagttgacattaaagttccagggtggagttggagtaattttgttttcctccaggggacacaagtgcagagaatggataaaacacaaacactaacagagaatagataaagcttcactctttaatgccacctcctggagcccatatgaaacccaagagtgaagaaagcaaagggttcttaggcataatagggcattaaggataaccatctcttatttcttttcattccagacagggtttggcctggcagttcaacctgattgcatgaagggttgtggtaggcagagatgtctgattgcctttgaattctttgttttctaaccagaggggagatagttctttcaacagaaagtcccagcaagtgcaacaacaaccgcggcctggtgtgcctctacttgccttggctgcctcagaaagagccctgaacactcctcctagggcctgtctatgaaaccaactggatgtagtcttattatttatcagaagttgccaagcaagcagtggtagacagcaggctttcagggaattatcccagggattccttaccagtcttcaaccagatatcacaccagagcaatacatattccccatgcaagaagcagagtaagcaatccatacccttagatacataacactgattagtgcctctgttgttaaagttatttccctttgtataagatgtattcaatgtttcaatgtttacagtgaatttaagaggtagatataatagttatggtgaaaaccctcattttgcagaagagaaaacagaacattgcctatgcaaaatgaatctaccaaggtccgcagctattaagtgcaaagtacaggatttaaacctgttttgaaaaaattgacaaagtctcagggccttgtcctgggtccattcattccattcagtcacatatattctaactcattcattcattcctttagcaaggatgaatagagcacctgctacgttacaagccctactctaggtactcaggttacgtcacagaacaagaaagacacaaacatttgcctctgcagtaagatatagaataaaatatgtataatgtctccctttccattgtcagccatcaccttgcgcagcacggctttctacttaaagagtgtttattgtgtaggcgaagtgggcacagacaacggacgataatcacaataccagtttaaatactagataaaaggtgctaagtgatctggaagaaagagaggagggcaaaggagatcagaagtgttaggtagaaggacaattacagttttaagtaggatgactatggtagtcctcattgaaaaggtaaatttgagtttgaataagctccagagaggaatctgggaaagagctttccaggcagaggacaaagcaagagaagagattctaaggtgccaggcatggctagagccttgcctgtgagtgacgggagagtagtggaagctgaggtttgcaagataatggggccaaatcatgggggcccatacaggtcattgtgatgacttaggcttttactctgtaaaaactgtaaagtcactgctgagttttgagcactgaagtggcataatcaaattatattttttcaatgattccattggctgctgggttaatattagtttgaagggggccagggtagaagcaaaaaattcaaagaaggcatacaacagagacagtaaaatatgtgcatgaaagccttccagtttgtcctgggtatttatgaagacacctcacattctctttttgcagtgaagtgagcatgatatgactcggttttgcctagaagcgacatcaccatttccaggcctggccctaaaacctgacatgtgttctaaactctgctccttctgcagcaaccattgagaccctgtgttgtggatgaaagcattgtagggtggaaggagctgaggtcctcaatgacagcgtggagcacaaccaccccttcccatgccaaccacactgggctgtgacttgagtagttttggaaactataaaaaagaacattttgtaaaaattccttgtccctctctatttctttcaaccttgttgccagagattgttgagattcacttcctgtttttatttttcaaagcaagaagagcagggcacgggtcaaatgcacctcttctccacatctccccaacagctgcttaaaatcatgcctctgtcctatcacacttttcaacatcacagcctgcctcggggacctaagacacttattatggagaatctctaagtcactctgtgccgaatgtggaaaaagaaaacactataaccacaacaatcattaaaattaaaataaatttgttttccctttcttcctaaaaatatatcaaattattggcaaggtttccttgaacatttcagcatgtttactatttgtttgaattcttttctaagcagattgtcattcactataccagttgttgaaaattatttaaactccccacaccaccaaatatatatatagagaaagacaaatagagagatagatatagatattcttttaccttccttcaatttgatgttttatcagatacctatgtttagaaaatttcaaaggtagaaacccaattagccttaatgatagacaggaagtaaacttttcccaaagaaattaccataattctccctaaacagcctcttggacatagaaaaggggaaatgaggattaatatgcttactacgtgctgggactacactgggaacattatttagaatatttcataaatatcttcagcattactcttagccagcttgtggttaagatggaaggagccagtgctagtattatcttctctgacaaatgataagcaggcacaaagaggtgacatgactgtcaccatcccacactgccaggaagagcatatctggatgtgtggggcacatcactgcagatgctattactttcttttcctggaacagtcagaggtagagaaacactgcaaaactgatccagaacaactgggggatgcatagcagcacagcagtttaggaaaccaccattggatttggccaggactgggtgtggatcttggttttgtccctttctggatgtggtctttgacaatgttgctcagtctttccgtgtgtccttaaacatcagtaatggctatagtatatttaacatggtctctggcgtattatgagtactcaaattgtagccactgtgtttattctagtaccactaaaatgtctcctgattttgaaaggagcatccccagagcattgtgtggctcatttacagatttgtaaaatgtaacatttacctacaccctcaatatctgctgaacactttcaataggcagtgaccatgggtcctccttgaaggtcataactagttaagtcaggaggattcttcaggggtttaggagagaatgagagagctgactcccggaagtgggaagggaatcaccctgactatttcctgtctttgctgctttcctttctcataagggagggctctgggaatgggaggcagcagcatccttgtccatactacacatcctttgttccctcccaccatgggcaaggagggatggattgtagcatagccatgtgagaaccatggagcaaaggtggaaggctagagggcagcagggaatctaattagcactagtcaattatctgttctatgcaacctgatgagtttgctgtcagagggaatgcaaaaacaacaacaaagaatttgtttttcatcttcatctctatgagctcctgtggtgcaactgtcagaaagcacttgccccaaatattttatttattgtcaacttttgcagagaatggagtaattcccatgggatctgctaggtaggttaatggactgagaagattaataaattatagacatggtactttgtgcaatgtactaatgtgtattgaacattatttcattagatcattacaaaagattgccatctgatgatgttttctgttgctataacagaatacctaagactgggtaagttataaagaaaataagtttatttcttccagttctggaggctgggaagtggaagagcattgtgccagcacctggtgagggccttcttgccgtgttacacatgatggtaggtgaaagctcagtaagagaggaagtatgaggggcagaactagctttataaaacccactctgaggataactagcccactcctggcataaaggctttaatccattcatgaaggtggagtccccatgacctaatcacttcttaaagaccacacctcttaatactgatacaatggcacttacatttcaacatgagtttcggaggggacaaacactcaaactacagcagtagctatcccctttttagagataagaaaaatgcatttagcaaagttacatagccagaaagtgtcagagtcagaaatctacccaggattgtctactctagcctcttaagcacccatatctctctattacatctccacatttaaaacaaaagccatggcatatgattctacactgttgaggggactttagggtgcttgctgtttgagcccctgagacaggcctcacatccagtggagctggtgtctggcctcagactgcaagaggagaaagtgcacatctgttagtctttaacatgcatcattgaaattcttgcaaggagtctggatggagctggtgttcttccctgtgcgtgaccttaggccagccagtggccagcaagagagaaacacaccaaggttcccagggaggctctgaacaactctttcccggaattgcttttcctgcccaacctagtgtgaaaggaatgtggtgagtggtacatccagggagatggcctacacggataccttctttgtgtctcttattatctttaggtttttactgatgccctgcacagagagaggtctgtaaagtggcaagcaggagtctgctacaatggaggaaaggattttgctgtatctcttgccaggcccaaggctgcagagggaattggtaatatacttcatttaataatagtgttttaagggacattatcatttcatcctatgtggtagatgtgatcatcttcatctcacagatgaaaagagacaaacctgggattcagaggtacttgcctatgagtttcttacagatttcctcttacaatccagaactgctgattcctgggtcagtgtcctttccaatatggcatcttaggcatggcaataagtgagatctaaaagctagttatttgatgcttggacaaaggcttagggcatgggctttgacctaatgaatcagtagattctagtctaatattttaaaggatttgaaatgattccagtttataagcccctttaactgtcttctaagatgtggctaaacattccaaccttccttagctcaaaagtggacaaaacaagagattacacatgttgatactttgggagtcatagaaaattcacatatacataggcagagtggttctgtaattaaccaaatctttagaggtccaaggttaacagtattgaccattcataattagccataaactcagacattttaaaagcctcatgaaaatagaagtatagttttcaaatgttacagaccccaaacaccagtgttttattgcctacagcaagcatagctcacagatcatcacaaggccttgcacaaaggaagcccagtgaatatttgtagatccgatttaattaatgaaggcacaaaccccctggctttcttgctgggtttcatgacatcttattaaacacactttatttagcaagcttggttatttgcttttttttttttgtctcccagcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgcaaaaagcattccttttcatcctaatctctgtaagctccaatatggtacagctgtcagaaagcacttgccctgaagatttcctttatcatcaacttttagagtaaatggtatagatctgccactgcctattctggtttcaagatttggtcttacatcgtttttttcctttttgtggcaaacaaaatacaaaaacaaatcagcaaacaaaaaatgaaaacaaaggaacagacatttatatatatgtatgtatgtatatatatacatacatatatgtatacatatatgtatgtatatatatacatacatatatatatagacagagagagagagagagagagagatatgtttgcatgtatagttagtgatatggtttggctctgtgtcccctcccaaatctcatctcaaattgtacactcataattcccatgtgttgtgggagggaccctgtgggagataatttgaatcatgagggcagtttcccccatactgttctcgtagtatgtgtgagtaagtctcacaagatctgatggttttatcaggggtttccacttttgcatcctcttcattttctcttgccaccgccatgtaagaagtgcctttcgccacctgccgtaattctaaggcctccctagtcatgtggaaatataagtccaattaaacctctttttcttcccagtctcaggtatgtctttacaagcagcatgaaaatggactaatacagtcagatagatgatagatatagatatagaagtagatatataggtatggatttaatgtaattgttgttagcaatgaattatgagcaaattgtctgtagaatgcaagacagaaagaagccttctttctatgctgagtttatccatattcctatgacactgataattaacactgtaccaattaattaattagtacaattaacatgtattgattagtcactgtccataagcaaagccccgagtttgactgaggtgtaaattcagtgtgtggctctagtatgaatgaatgaataaatcatattgatgtgcgtcatgggggcaaggcatagatttactgtgctaatccacgaagatttcttaaagagttaatcactagacataatgtataatgtcaataatggacataatgatggattaaaaatgtcaatggtagaaataatgatggcaatacagaaaagagttacattttattggatatctggtgtttgtctaaaataattcttactactttatctatactctcacaataaatcctcataagaacacattgagacagaagtcattagctgctcattattgaacaggaaactgagaatcaaggaggttaactcaaaaccccaattcactcagctagtaagtgacagaactgggatttcaccctaggtctgcttgtctttaaaatccctccctcctccacccttctttctatttttcaccctcccccactttttcttctcccctcttctttttcttctcctttttcttcttcttcgtccactccttaatgctagctaagctcatagatgtcttctttgatgtattatccctgatatccttttcaagagtaaaatgattaaaaatataagcataaacatttattgacacctactttttacaaagcactgtggcattaaaacttgcaatttataaaagaatggggcaatagagcacatgtttgctaaatgcttatgatgaatcaggtactatatattttacattaccactttttaatcttctcaataacaatatctattttattctcattttacaagtgaagggactgcagccaagaaagtgtaaggaagaaactggtatagaattacatgtcctgtagaaactctgacttgcctaaatagtaaccaattcaggcaatgtctttttagctgggccaagacacacagaaaggagtgatgctctgaacctctaggactgaagggcttgcacagcccctgtgctcaagcacacacagagcctcaaatggaatgttttggagacattcttatacagaatatgggaggtataaattccagagggccatttgatggtaagttatcaagtaggtaaaagagtttattggctgaccgaacagttacattcctataaatgatatgatgaatgctaaaaaaaaatgcatgtatacagtgatgctctttgtgcatgctcttaaaagaaatagtaaacaaaaatggtataaagtaaaagttaaactcaaataatatagacacttcataaaataatagcattgtcatacaatggaacaaaacgcagctgttaagatgacttacacccatattcaatgacatgaaaacatgtctaatgtatagcccaggtaagaagcatttcaaaactatgtattagggctgggcatggtggtttacacctataatcctagcacattagtagagcaaggtgggaggaacacatgagcccaggagtttgagaccaacctgggcaacatagtgagatcctatctctttaaaaaacagaacaaaacaaaacaaaatctatgtattagatactgaataaatccatatttctagaattaacacacacatatacacctgaaaaaaatgtgtatgaacccacaactttatttttgattggcttttgattgtgggatgaagaataatctatacttctttcttaaaattttcccaaattttttgttttctaataatataaactaatatttattgaatgcttacagtgtgaaaaataacttatttatacttctttcattatcacaataatccctattttaatattatgcaacctgaggcacagagaggctgataggctacccaagagagtggcagagctcaaatttaagtagattttctgcttctgcaagctcacggtcctatctactactttatactacaattgctacttaacaattttgacattaaaaagtacaattgaacaacactaataaaaataacttaaaatttttgcttccagaaaatgcacaattatctgttaattttacacaacataataagtggagtttccactatttcatcatttaaaggctaagccattcttcattttcaggtgtctccatttctttatttttgacaacatgtctttcagaagatacttaaaatagatattgtctaatgttttcttaactcctgggaaagattgccgcacggaattatttagcatccaaggtgtcatgggatgttttaagaggtagagtatgtggttttagtggtggtatggttgtttctttttgtagaggaatttatggattgccaagtgtcaaactcaagaggtttaattgcaatttaacttccaagccacagccttcaaatgtatttgggactttataagacatagtacagctcccctgagaccccaccaccctgtgggctgctctatcatggtacttatcatggttcctaaagcagtttgactttttgtctagatgtttcattagactgaaagctggatccgtcttgtcaactgctgcatcctcagaacttaaacattcagcttattctgaagtctgctagttcgtagggccaggaagttctcaaaatgctagtattgaatgcagggtgcatctcctctcctatcccccttaaagctattttaaaaagtgtgcgacatttctgcattctgtaaatcaagatggaatctatctcttggaggagacttttagatgtgcctttgttaccttagagatataggtaatttatcacttattgttctaaggaaagtttagaaccaaagtaataatgtagagggtttgtcctcagtctagaatgtaaggttctcaaacaaaggatgttcattttaagcagaaggcatctctcagtgatgatgatgatgctgattttaatttcttcaatgttctggtggggttaagagacagcaggggttaaggcgacctgagaaaagcaacttttctcctgtgacacctcaaatgctgagaaaaatgaccatgggggtgtcctgtaaagagaataaagagaaatggtgtgtgtactcaagggggagatattttgtatccagctctgggtttttatttatgcattttcactctcttgtatcatgctcaagccttagcaaagtttgataaagttgagtgttttgtctcagctgatggaaaagaagttgggggcattgacctggaatgagagatgagaagcccaactaagatagatttgtggaacatacaatcacttcctagggattctcagaattatatgggaaacaggcaaggcttcctgcatactcagtattgggacctggatcatattatttggatgtgaaagggaaagctgccccaaggaggatagagagcctggggtcacttggcttacatttggtttagaaaatttaagtttcctataggataaagagcacagggaagatatctgtcaaacatttcatagcccaattaactgaatcagttatttattcccaaatcactatagctttacaaccataatttgatttcatattcccaaagatacacttatctggtaaatattttatagagttaaaatatctttgagaaaacataggtttttctgaatcctgatattgtggcaattttatcaaagcacagtgaagctccagcttagaaaaattaaaaccatgatcagaaaactgtcctcatgaaccaatctctgtctttgcatctccagcataactgaacaattttcatgcatttctaagaacaaattgcaaacagacatcccaagaggatgttttaacacatcaccaatttggaaacgatggctggaaatgtcagctaggagaaacttttagacacatatgatgggatggaccagccataggcacatatctcttagactgagagtggtaaacctaagaactggagaagcagggttaaaagaacaagcccactagtcttctcctccatgaatatatgtgattactacagtgtctccttatcctctcaaaggattgctgtctttggcaaagctaaggatctgaacggcaaaaggaggtgattgatggtccatgattggatttccagagcagaagctgaaacctctgagtactgactccacctccttgacttctcccctgccacctcctccttaactgatggccagtggccaactgagagtcccaaccagggaaagccatttcctctccccagcatgtctggagggcatcatcatcttctgtgcccatttctcaggtgtattgccacatcagtatatgatctgagatggtatctccagcttcctaaacaactaagggagatcacagatcaaaggctttgggaggaaaggcaaggccagtagcaaggggaattctttccagaagaaaaaggtaatcacttctcaagacataatctgacccaagccagttaatatcatttgcatcttgcatgacttttgttaatggggctcagtcaacttgacatttttaaatgtttcattgttttagttcttctagataaaatcatgactgttcattgaactgttgtatagactatagactaaataaaagtggcttttaatgtgtataatgactaatctactccatttttaaccacaactgaaagctatgaatgaatgttaaaattttgtatcaaagatactcaaacttttggagtttttctttatttggaaagacagaaatgtttactttttattgttaccactctcattttacatagaataaaatgaagattaaattagctaaagacttgaaatgggacaaagctgggagtattccaggttggatgagacggaagcagtgtcctatcatgaaaaaagtattgataacaagtatcagacaactttgcccactgtcttgggcttggagatacagtggctagaaaattatgccctctgcctccagggacatcagtctcacacgggaggtctctcagaagcagaaaattgcagtagagaaatgcaatctggtaagtgctacaaggggagaagaagacaaactgggaggccaccctttctaatggggggggaaatgtgatatgccaaggaaaactctgaatg

SEQ ID NO: 10799 - DNA, 17462 bp, Homo sapiens
  misc_feature (1)...(17462): n = A,T,C or G, or insertion/deletion polymorphism (see Tables 1-2)
gtacagggagagattaaaaacaacccaagataagactctgtcgctcaccctcccagagtgatgtggccccaagctggcaagaaaacaattctaatggagacaggaaattaaaagacagatctttcctctgccacagattagctttatagtatcgaataaagcaaggaaagaccctactttccatatctataacatggagagatgttaacatgaaaatagattttcttttccctatcagttaaggaaggcttctctttaacacaaatgaccactgtcttttgcttggtctccacttctttaagggaaatatctttggaaatggcaatccatgggaacgtttcacaaatactctgtcatcgcttatgtttcttgaaccacctaggtctgtacttgagttcatactctatctggtagttgagcgcttaggagtgcttagctaaatagatgctctgttgtttgaaaagtccacctacccctatttctgtggcgggctggtcactgttttgtgtctatgttttacactgactgtgccatctctaatgttctccattcctggacttttaggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctctttggaatgtaacaataaaaataatttttgaaacatccatcagtgtatctatctatgtctcctagttttttcctcctccctcttttgctgtataatgagattgaagatataaagacattttgtaccctgttctgagactactgttttataccaatctaaccgtaaaatattggtgtaaattatgtgtttgcatgtatagacagaatatatgaatttgggggtggatctctgaaaagtatactaatattttgataaattgggagatttcaaattcctgaaggagtacttgttctgagaaattcttggcccaaaaaaatcagaattaaattcataaaagtgaggttttaggagccattaatgggattttggggtttagtaaaattttaagcacctacaaatatataaattatcaattttattgttagtattaaaaaatttaatttcaaccatgaccaagtgggatttatcccaggtatgaaaagctggttcaacatttgaaaataacatttctaaagaagaaaaattacatgaattttatcaatagcagaaaaagcatttgacaaaataaccccattcatgataaaaattctcaggaaactaggaatagagaacttcaactagataaagaaatgagctaacaaaaaaaccacagctaacatcatatacttaataatgagaaattagaagctttcccattaagatcaggaataaggcgaggacgtcttctcttactattccttttcaacattgcactggaagtcctagttgtactggaagtcctagccaatgcagtgagacaagaaaaggaaataaaaggtataaatattgagaaggaaggaatagaactgtctttgtttactgatgcaatgattgtctatgtagaaaacccagaagaattgacaacaacaataatagaactaataagtgattataaaggcttgcaggatacaaggttagtatacaaaagtcaatcaaaccaggtgcagtggcatgtatctgtagtcccagctactcaggaggctgaagcaggaggattacttgaagccaggagttttgaggctgcagtgagctatgattgctgcatgaatagctactgcactccagtctgggcaacacagcaagaccctgtctctaaaaaatgtcaaccgttttcctatatatcagccacaaacagtggaatttgaaattaaaaacaatactattcatagtagcacccccaaaataaaatacttaggtataaacctagtaaaatgtatctaagatctatatgaggacaactgcaaaaatgattaaataaaccaaagaactaaacaaatgaagatatatttcatattcattaataggaaggctcaatattgtttagatggcggttctttccaacttgatctattgattcaatgcaatcccaatcaatatcccagaaagttattttgtggatattaaacttattctaaaggttataaaaaagccaaagacagaatagccaacacaatattaaaggagaacaacaaagtcagaaaactaacactacctttgagacttactataaaactacagtaatcatgacagtatgctactggcaaaaaagacagatcagtggaacaggatagagaacccagaaataggcccatataaatacagtcaactgatctttgacaaaggagcaaaagcaatacaatggagaaaagatagtcttttcaacaaatggtgctggaacaactggacatccacatgcaaagaaatctagttacataccctgtacccttcacaaaaattaattcaaaatagatcataggcctacatgtaaaatgcaaaactacaaaactttcagaagataacataggagaagatctagatggtggtgatgacatagctgataaaggactgctatctaaaatatacaaaaaatacttaataagggacaaaaaatttgatttaaaaatgggcaaaagtcctggacacctcaccaaagaggagatacagatggcaaataagcatatgaaaagatgttccacatcatatgtcatcagggaaatgcaaactgaaacaacaatgggataccaatacacacctattagaatgaccaaaatctacgacactgataacaccaaatgctctcaaggatgtggagcaacaggaactttcttttattgctggtgggaatacaaaatggtacagcaaccttacaaaactaaacatacccttactatatggtccagcaattgtgctccataataattacccaatgagttgaaatcatgtccacacaaaaccctgcatgcagatgtttatagcagctttactcataagtgccaaaatttggaggcaactaagatttcctttagtaggtgaacggataaacaaattgtgatacaaccagacaatggaataatcagcgctaaaaagaaatgagatttcaagccatgagaagacatggaagaaccttaaatgcacactactaagtaaagaagccaatctgaaaatgctatatgcggccaggcgcggtggctcacacctgtaatcccagcactttgggaggctgaggcaggcagatcatgaggtcaggagatcgagaccatcctggctaacgcggtgaaaccccgtctctattaaaaataaaaaaaaaaaaaaattagctgggcgtggtggcgggcacctgtagtcccagctactagggaggctgaggcaggagaatggcatgaacccgggaggcggagcttgcagtgagctgagatcgtgccactgcactccagcctgggcgacacagtgagactccatctcaaaaaaaaaaaaaaaaaagaaagaaagaaaatgctacatgcataattaacaactatctgacattgtggaaaaggcaaaaccatggagacagaaatatcagtggttgcaaggggttagagaaggaggagggatgaataggcagagcacaagatgtttaggcagtgaaactattctgtgataccacaatggtgaatacatgtcattatatacttgtcaaaacccacagaatgtaaatgtacaacaccaagggtgagccctaatgtagactatggactttgggtgattatgtatcaatgcaggttcatcagttctaacacagtaccataatgatgtggaatgttcatagcagaggaggccatgcacacgtgggggcagggagtgtatgagaattagctctactttgtgttcaatttttctgtgaacctacaattgctttaaaaattaaagttggggccgggcatggtggctcatgcctataatctcagcattttgggaggccaaggtgggcggatcacctgaggtcagcagttcgagaccagcctggccaacatgatgaaaacccatctctattaaaaatacaaaattagctgggtgtggtggtgcacacctgtaattccagctacttgggtggctgaggcaggagaatcacttgatcctggaggcagaggttgcagtgagccaagatcacgccattgcactccagcttgggcaaaagagcaaaaccgtctcaaaaaaaaattaaactcggcatggtgcagcagtctataattccagcactttgggtgggatttcttgagaccaggagttcaagaccagccaggcaacaaggtaagacctcatctctataagaaatacaaaaattagccaggcaagttggctcgcacctgtagtcccagctgctcgggaggtggaggctgcaatgagctgcggtcatgccactgcattccagcctgggctacagagtgagatcttgtctctaaataaataaggagagaaggaatgcttctaatatttatatttttaaaaagataaaagtatacttaagaagaaaaaataaaatggctatttaagaaaaaggtattggctagttcctatgatactgggttatcagaatttaacatccacattcgtgtcactaaagtccccactgctaaatccgactggctttaaaaaaataaaaagtaaaaaaaagatgtaagttcgtattgaccttcctagttctggccttaacctctatctaaaagaatactggccaatatttgcacattatgagtctattgctccataaataattttgatataatatcatataacccagaagaatgggggacattctttaaacaaaagaatttgttacaagtatccagttttgtaagcacgcctttctatttagtatggttatctgttgtcatatctacacattggataggaaaaacagccaaaccagaactgagcagttctgtttaactgtaagctactttgcatattgttattaaatgatcacctataaatcaggttaagtccaactcagcccaaaatacagcatcctgacgacaaaactcaggtaagagactattctccagagtggcccgtggggaagaataagaacatgatttttaagaaaatccctaggtacagttgataaatactgaattttgtcagctatcggattattccattatttcaaactacyaattattccccatataatggaagatccaggttttgctggcaattaaatcatctagaagagcagaaggagttttgatttggaagtygggacactaggttctggcccctgctctgctactagctttgtaaccttagcaacatatcacaacctatgagraagttttaagtttccttctagctctaacattccataattcaattatatcggcagttgtagctttttattttttacatgctacatatcttttatatctctgaaatttgaagcttttatgctcagcagagcatccagaatctcttacaattttatcattaagacctcatcatttatttcccagaatygctctaaggcagaatctgagattttcccaacataggtgtgtttgttagctgtgtctgtatctggaaccatggagccccagcactaccaatctgtgttgctttcttttaaaaacttanactcaattcctacaaacacatccagaccccactaggctttctatcttgattctccttgttgctgcattttatttcattttctcactctgttgccttaaattttcttctttgaataaaaggtgatcatatttaaatgctagtacattgattggtgaacttattggaaatgctcaacagaaaaaaacttctcatcaatgtgcctccagagacaccatgctcttttttcaagaattacgaaaatattgttaaaacctagaaagttttaattacttgtggcatatacaaattactcagatttcatctgggtcaagatttaagatattgtttaaatggtcttttagggtaaaaccatcaccaaaagaacgatttttgtatagttaggtttgatgacatctgctttactttttggtagcctgttaattccagcttgttaactacaggcaacaatatggctctgctgttgtcggaagtgcagtaatacgggctccacacccatttgccaccattttgcagcttctgccatacccgttctttctctcttaccctctagaattcctggcttgggaatttcctaacttgtttctctcagtaactttttctttttgacagaatcctggctagtttttagttttccagagatttttgttttgttagttatcttaggtcatttggtcagtaatttggaatctttcatttcctgttcctctgtttcgatttttaattggagctatcccacttatctcatcccaccaccccgtcgcttttaagaagagcttttcctggcattgasttcttttccagcctctttcaccatgncttactatagccytttaaccctggcactcctccctcccggcacccctgcccctgctgcccttgctgtttccctagtcccctgaccttcatacttgaattctggtcttaggggctgctcctcccactacacagtgcagcctgctgagtttttgctgtattcaggtagagaaacaagtgccaatattatctaatcttgccctaaacattaggactggtktgtgtgtgtgtgtgtgtgtgtgtatgtgtgtgtgtgtttagtatgccaagcacagataataacccctcactcctaaagatgctgaaaaatcaacctgctgagaaattaacaccatatttccttctttgatggaggcccacaattagacytcaagctgctttcccttctccattttaggtatgttcctcatctctcaacatgtgtgtttaggatagatcagtgctgtgactctacagtgttaaggaaaacataaaccaggttttctataaggtgcagtttagaaaggaacgctacataaggattcattcatctctaaagaaaggaaagaggcaaatgctgggtgcattataggcacggtcactcctctgtacctggggggttgggtttaggactccccttcggataacaaaatccacagaggtccaactcccttacagaaaataacgtagcacttgcatggaacctacacacaccctctcaaacactttcaatcatctctgtgttacttataatacctaatgcaatgcacattctatacaaatagttgttacactgtattgtttagaggataatgccaagaaaaaatgtcagtacttatttagtacccatgctgccatccctttyttccccctgaatattttccacccatagttggttgaatacacagatgtggagctcaccaatatggagggtcaactgtagttttttcactttatcctcacaaccaccctgcagaatagttagtagctcatttggacatggggaaagcgaaagctcagagaggttaagacacttgcctaaggacacatagctaggaaggggtaaggccatattgaaacctgagggtgttatgactgagagaaaaagctctttctccccccgcctccaagttaaccggttacactgcagtggctctgtaaaatctgttgttgctacatgattacaggcagaggcaaaaagtaacagtagtttaaaacaggagaaggatatagacctattcacaaagaagaaatgcgttggtgtggaacctcttgggttatactgcttcatccttgagttctacaaaaacacacacacacaaaaaccaacaaaacttaactataggctgggtgaagtggctcatgcctgtaatcccagtgctgtgggaagatcttttgaagctaggaggtttaaaatcagcctgggcatcaaggcaagaccccatctctacaaaaaaaaaaaaaagccaggcatggtagtgcacacctgcagtcctagctactcagaaggctgaggtaggargatcacttgaacccagcagtttgagattgcagtaagccatgatcacattactgcactccagcctggctgacagaacaaaacaccwcctctaaaaataaaaatataaaataaataaaaaaatttaaaaacctaaacatagctgcactttactcaatatatttacagttctacatatgtaaaaacttgtatattgactatgttttaaatgtgtaggggaagtttctcacctaaaggagtcccatagtgaacatttaagagcaaatgattccttttttatttgtatttttggttttgcctctagcacatcaggtattctttaagaaggctatgcctctgaggttgcatgatcattaactaattcataatttcccttgcatatatttgrgtattttggtgtttcagcctttcccacactttttttatttgcatgtcttcacgatcaccattatatctttgttccacctgtactattatttactcactctttgtctttaaatcaaatcacgtttcttactcaagtagatttagttttaagacaaaccttatggccgggcacagtggctcacacctgtaatcccagcactttgggaggccaaggcgggtggatcatgaggtcaggagtttgagaccagcctggccaacgtaatgaaaccccgtcyctactaaaaatacaaaaaattagctgggcgtggtggcgggcacctgtaatcccagctacttgggaggctgaggcaggagaatcacttgaacccgggggggcagaggttgcagtgagccgagatcgtgccactgcactccagcccaggcaacaacgcgagactctgtctcaaaaaaagaaaaaaaggaactttatgtcgctaccataaatgtgaaattactagaactcacaataaatagaagttagtaaagacactgaattctaactagacgctattgcttgttgaaggctttgatcttaggaggattagaaagcattctaggccaggcacggtggcttcctgtgtgtaatcccagcagttggagaggctgaggcaggcgggttgcttgagctcaggaatttgagaccagcctgggcaacatggcaagaccctgtctctacaaaaacatacaaaacttagccaggcgtggtgatggccacgtatggtcccagctactcaggtggctgaggcaggaggattgatgaacctgggaggctaaggctctagtgagccatgatcacaccactgcactccagcctgggtgacagagccacaccctgtctcaaaggaaaaaaaaaaaaaaaaaagaattctagtggtgtggtgtggaagacacattctcagcagactaaggttgtatctttataaccacaaggattgaaaaagaacggaaggacaataactttctcataaggtgattcaatgttatttagtgctgtttctgtgtaccatcaaaaatcctcttactacacacagaatattataacaccatctcattgtccacatgagctcagaaattggtcatcaaagcagaaaagtctttaaaacattgatctcnggccgggcgtggtggctcacacctgtaatcccagcactttgggaggctgaggcgggcggatcacaaggtcaagagatcgagaccatcctggccaacatggtgaaatcccatctctactaaaaatacaaaaattagctgggtgcagtggcagacgcctgtaatcccaagctactcgggaggctgaggcaggagaattgcttgaacccaggaggcagaagttgcagtgagccgagatcacgccactgcactccagcctgggcaacagagccagactccatctcgaaaaataaaataaaataaaacattgatctccaagaaagtagatcatatctgctctctatctgaccacattgttaaacttggttatgtttgcaggttaaagaggaaatgatggacaacagaggcaactctagtctacctgacaaacttcctatcttccctgattctgcccrcttgccactgaccaggtccttctatctggagcccatggtcactttccacgtgcacccagaggccccggtgtcatccccttrctctgaggagctgccacngctgccttttcccagcgactctcttatcctgggmaattacagtgaaccctgccccttctctttcccgatgccttatccaaattacagagggtgcgagtactcctacgggccagccttcacccggaaaaggaatgagcgggaaaggcagcgggtgaaatgtgtcaatgaaggctaygcccagctccgccatcatctgccagaggagtatttggagaagcgactcagcaaagtggaaaccctcagagctgcgatcaagtacattaactacctgcagtctcttctgtaccctgataaagctgagaccaagaataaccctggaaaagtttcctccatgatagcaaccaccagccaccatgctgaccctatgttcagaattgtttgagttgctgtttccaaatagaaatgaataatatcacaaaatggggtctcttacggcatcattcaatagtttttcctaaatgtaatttccatgtgggcaggaaatagctcaaatgctaacctatgctgggtattactcgcttgggcttcaattgtactaaacatgatctcatgtaggttgaggagctgctctgcttctttcacgaactctaggggagcagggggccccagagtttctgcatgtctcaccctgcccttctcacatgctcggccagaggctgagcatgtgagaagctctcacggaagcttgtgaagcgtgactgctaactacctgatgccggtcgtcacttcgctgaagcgtcgtgctgagcaatcacaatgaacttctctttatttgtcaacatttggagatttttacttattggggattgacaagaagtcaccaccatgggaaagtgtcttggggctaaagtgaaagtagtttacaaaaccttgttgttatttgaaattatttcagatgcatcattttcctgcatgcagacttcttcaggcagcttagtatagggtctaagaaggcagagctgtggccgggcttggtggctcatacctgtaatcccagcactttgggaggccgaagcgggcggatcacaaagtcaggagattgaggccatcctggctaatgcggtcaaccccgtctgtactaaaaatacaaaaaattagccggtcatggtggcgggctcctgtagtcccagctactcaggaggctgaggcaggagaacggcgtgaacctaggaggcggagcttgcagtgagccgagattgcgccactgcactccagcctgggtgacagagcgagactccatctcaaaaaaaaaagaaagtcgggcttggtggctcatacctgtaatcccagcactttgggaggccgagacaggcggatcacgaggtcaggagatcgagaccatcctgtctaacacggtgaaaccccgtctctactaaaaatacaaaaaattagccggcctggtggagggcgcctgtagtctcagctactcgggaagctgaggcaggagaatggcgtgaacccgggaggcggagcttgcagtgagctgagatcgcgtcactgcactccagcctgggcgacagagcgagaccagacctgtatctgcagtataactctgctacctcttctctatgtctcggttcttctccacaaaatgagaataacaacaacagcaattcccatgtgtttatgatgatgattaacagaccttgacatgtaataagtattcataatgattaaaaacttttttttgagatggagtctcactctgctgcccaggctggagtgtagtaatgcaatctcagctcactgcaacctccgcctcctgtgttcaaacaattctctgcctcagcctcccgagtagctgggattacaggcacccaccaccacacccagctaattttttttgtatttttagtagagatggggtttcactatgttggccaggctggtcttgaactcctgacctcatgatccacctgcctcggcctcccaaagtggtgggattacaggcatgagacaccactcccagccaaaaacattttttttagagatggggtcttcctatgttgcccaggctggtctcgaactcctagcctcaaccaatcctcccacccctgccttctaaagtgttgggattacaggtgtgagccactgtggctggccatcattactgattattattatcattatcttgttttgtccatagcatcaccattctctaggttctctaagctagaaaacttggagctgccaggcctttccttcatacctgggaaggacagtccctgccccgtatcttggggtctgccttcaaagtgtgtctatttctgcttccatggccagcttcagctcttccttctcctttaactcccaggtcccatctgtcccaaggcccagtcagtgacctatcccacactgtctatcacactcctctccactgctatgcctctatgaagtcttctccaacttcctatcctagccgttacttcttcctttattttgtataaatatttctcttgtggttgctatcctgctatctttagacactttacacacctatctctgtcttcttcagtagactgcaagctccttgaagataattcatccagccttattcatcttctattcctagtacccagcaaagagcctcaaatcaggaaggtgtcggtgaatatctgttgtcactgttttcttattccaatcccgtcacctgtgtctgggttattggtagcagtctcctgtctggcctcttgggatgcgttctcaacaggctccaccctcactctctctgaaggtatttcatgtcacttcatcgcttaagctgcctgatgacttccttctgaacgccaccttgtttaaatttatcagcttagttttcaaagctccctactgcaaaacaaagcagcaaacataagaagccgtgttttctcatttctccttgccagcaacatttcacaaagcccctgactcttaccgcaggcagctctttcgctcttcagaaagaagctttgaagacacgacaggacagagtacacgcccctctccctcctccaccccgtcatctcctgcctgagtcactacattccttaaaagataaatgacccgagttttggccttttcctatatgcaagataacatctgatgggattagcgatgatgcctctgtaatctataagcaggattactctcacacccacactctgatgtgagtctgctttaatgtgactcctaagcaagttcaatgtgattttgcatgtgctgaacccatttcccccaaacagaaaatcacagtctcgcaaatgtatccttctctcttctctcttacttcctacctaaactggaatattctccttttcccctcctccactgaaatcccactgtctcattcaagaatcattctttcactgccagagacttcatgggtattttttaatttattttttattttttgagacagagtctttctttgtcacccaggctggagtgcagtggcgcgacctcggctcactgcaacctctgactccctggttcaagcgattctcctgcctcagcctcccgagtagctgggattacaggcgtgtgccaccatgcccagctaattttttgtatttttagtagagacggggtttcactgtgttagccaggatggtctcgatctcctgacctcgtgatccacctgccttggcctcccaagtgctgggattacaggcatgagccaccgcgcccggccatgggtctttcttagactctttgtgtgccaaataactccgccttggtatacggtcctgggcagcagtcattctcctgactatgaagtgatgcttcgggagggcagtcatcagttaagaggcttttggttgcaagtaagaaacagcccaatccagagtggcataatcaataaggggaattattggctcacagagctgaggcctagagtagcagcactgcctgcaggcaggactcagtactgtcaccgagaacctattttcagctgggcgttggggtgcatggctgtagtccgagctccttggaagactgaggcaaaagcatcccttgagcccaggagtttgaggccagcctgggcaaccctgtctcaaaacaaacaaacaaaccaaccctctatttcctgaggtctatcctctctttctctgggaatagcttcagtgttcccaaaaggctgtcagaggctctcagaactatcagctttcttattcaggcataggaagaaagagaaagcctatatcccaggattcccaaccaaagtctccagattcctgctgattggagaggttcaggaacacgccactgcctgaccaacccctggggccagacggggatggaaggggtgactgacacccactctacccctggaggtgggtactttggcctccctatccacatggatctgccaactgaaacaggacctggtagaagcggggtatgaatgtgggggagacacatccaaacgtgcctgcataccaggcatataaccagtgcacagtgactggcagaggcctccaaatacgagcccctcccacaagcagaatctggacttctgttcctttgttgccagtgtccacacctctcactccaaatggtcacaacacctctgctcctcaacagagtcctgcctgttatagacaaacaggcccacacctttggttattttggtttagactagggacaaattctatcctagagtccccaggccgccagtggctcccccattcctgcctctagtgtgtacagggaggacgccctcagtttctgcggaggtggctcctccctcacaggagtctcctgggatccgtgagggcttcccaccaccactgactcttccagcagtggagcagcctgagctttggagaactgaggctacactggcctttttcccttcttcctcctcctcttctctccaaagggaaacctggagaacaccccctcccccatcacttcctgccccacccctacctcccaaggcctcctgtccccctctccgcatgctcggtgcactcactggccacagacgacagcgtccccaggctgcacccatggtaaccggcgtggcaaccaggagtcggttgggctgagaccctgagccccaactgtcagaaggagcctgaggctgaggtggaggctgggagtttggggctgtgggtaagtccttgtggggtcagacctgtggacttgggcaggggcagaccctcacggggctctggtgggctgcagcagtgcggcttgatcttgggccctggtggcagctgtctcctctgaacagggctggaaaggggatggacggccctgagatctcagcttgcctgaggccagaactagccttgtaggtggccggggaggaggaaggaggaaaaatactaacataagttgagctgctgaatacgccaggtgctttccatgtattctatcctgagtgtaactggagagcagaggttaagtgagcacacagccagcaggctgtaggggaggatttaaagctgggctgctctaaactcacagcacttgctcttccaatcccttccctgtttcctgagtggaggttcccaaggcaggtgactcaaagaggaaactgtgagagtttgtgggagcaggtagggccgtgcatggactcaactgtccccagaggcagctaactgcagagctgagccctgcctcgccccggtggccactgcttgcttcaagctgcagctcaggtaatggtggtgcctattctcaggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggtacctgtctctgcccctctgggggaagtggatgcccttttctttttcctttgttcttggctgttggtggtagaccttggtggacagacttgcttcctgagaaggtggaaaggggtcttcattgtttggcctatgattggcatatctgtgtggggtctgtcactccagcctacattgtgctcccagagccctccagggttgatctggctttagcagagttgcagatgctgcagttggcatgagtaagagaaggcagttagggatagccagttaccaagtttatagctcattttaccatcaatgctgagacttggctgggcgcagtggctcacacctgtatacaatcccagcactttggaaggccgaggcaagcagatcacttgaggtcaggagttcgagtccagtctgaccaacatggcaaaaccccatctactaaaaacacacaaaaaattggctgggcatggtggctcatgcctgtaatcccagcactttgggaggccaaggcaggtggttcacccaaggtcaggagttcgagaccagcgtggccaagatggtgaaaccccgtctctac

SEQ ID NO: 10800 - DNA, 12745 bp, Homo sapiens
tgataatcattgagtcaagtacagcaggtgattgaggactgctgagaggtacaggccaaaattcttatgttgtattataataatgtcatcttataatactgtcagtattttataaaacattcttcacaaactcacacacatttaaaaacaaaacactgtctctaaaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgttgctgttatgaaaccaaggcacagagaggttagttaacttgctgaagaaaatgatgtgctggatttttattctagctattctggaataacaactacacaaccttatgtctgagccaaggaaacatacggtgtggcaacagttaccatgtttttaggaacagcagcactcctaatgtttgctgcagggaaaaaggaatctcagaatttgcctgatccctataatttttttcctaaatattttgaaatatctttcagatgtattttaaaatttaaggatattttgttcagttcatacagaatttttttttttttctcgagatggagtctcactctatcacccaggctggaatgcagtggcatgatctcggctcactgcaacctctgcctcctgggttcaagcaattttcctgcctcagcctcccaagtggctgagactacaggcgcatgccaccatgcacggctaagtttttttgtatttttagtagagatggagtttcaccatgttggccaggctggtctcgaactcctgacctcaaatgatccgccctttttggcctcccaaagtgctgggattacaggcgtgagctaccgcgcccagccaaatttctaacttgttttgttgttgttgagacagggtctcagtctgacaccaaggctggtgtgcagtactgcgatcacggctcactgcagtctcgacctcctgagctcaagtgatcctcccacctcagcctactgagtagctgggaccaccacgcctggctcatttttttctattatttattgaaacgggttctggctatgttgcccaggttggtcttgaactccggagctcatgcgatccacccacctcagcgtccgaaaggattatcaggagtgagccaccgtgcccggccaaatttctaacttttgaattgacatattcatttattctctttatcattcagggagaaatttggggatggatagccttgaagcatcatccaccaagttattttatacaccagatttagatacaaagtatttttttattatttaaaaaaatcaaattctagcttttactctgaagattctaaaaagaattttggagtctttaattcatacttcaggggcaggggaataagtaccaatattcgtataactttcagtgcaagtcacgttagctaactgtagtctattgagttaaatatccttgatttattccttaaaactgagtcactatgacggcacttttttgtttttttttttcgagacggagctcgccctgtctcccaggctggagtgcggtggtgcgatctcggctcactgcaatctccgcctcccaggttcaagcgattctcctgccccagcctcctgagtagctgggactacaggcacacaccaccacgcccagctaatgtttgtatttttagtagagacagggtttcatcattttggtcaggctggtcttgaactcctgacctcgtgatcagcctgcctcgacctcccaaagtgctgggattacagtcatgagccactgcacccggctgaatggcactttcataaaacagtaaataaccaacttcactactgcccccaagagttttactatgtatatgagggcatctgttttaagtatgggtataatgttacgggtttttctttgtgtaagtttgggttcacaatttcatcattaaaacaaatgtaaaatactttgtgctttctgtgtgctattaagaaagtattcaagggaattttgaaaatcaaatttaattactctcatgtttgtaaaatttttgaaacaaatgtttaagagaggataatgttagaaattatctttccagccagacctggtggctcacgccagtaatcctagcattttgggaggacaaggtgggcagatcacttaagcccaggaattcaagaccagcctggacaacacagggaaagcccatctctacaaaatatacaaaattagtggccgagcgtggtggctcacgcctgtaatcccagcactttgggaggccgaggcgggcagatcacctgaggtcaggagttccagaccagcctcaacatggagaaaccccgtctctactaaaaatacaaaattagctgggcgtggtgatgcatgcctgtaatcccagctactcgggaggctgaggcaggagaattgcttgaacctgggaggtagaggttgcggtgagccgagatcccgccattgcactccagcctgggcaacaagagcgaaactccatctcaaaaaacaaaacaaacaaataaacaaaattagtcaggtgtggttgtgcacacctgtagtcccagctacttgggaggctgaggtgggaggatcacttgagcccggggaagtgtaggctaccatgagccatcatggtgccactgtactccagtctaggaaaaaaataaacattaaaaattttaaaatcttaaaaaaagaaaagaaattttctgtccagatatctttatttttaacaaatcgaagtgtattaatagtgtttatgggagcgtgcccacacaaggacagcaagcctaggaagtgcaagtcaagaaaactttttgtgaaataatttaaactgaaaagaaaaagcagagatttttttctagaaaagtaaggagtggaggtaaaaaaaaaacacagcagagacacaggtatgctacggaaccaaaggtgtgccaatggtactgacagtttaattcagaaaaaaatgaatcagaaaatggatatttttaaataagttaggttgctgaaaaagagaaatgcagtgaagccttagatgggagtgagataaatcagccattggctagaggagtttcttgcccaagaccagtggtgatgtccccaaatgcctggaaacaactgttgtgacattataaagcccccatagtctaagttgggtgagactatacttatgcattttctcacctgtaatatagcttaaaagtatttctactctgggatttctttacattttactaaagcgcaattatatacttaaaactgatagtgtatgctgggctgctagtcattctcaaccctggccaattatcagaattgtttgttgaatatataggtgccatatataggtgcatacacacacacacacacacacatacacacacacacacacacacacacaccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcccagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggccacagccccattctaaatattcccaatagaaattcatttattaaccagagagtggtgggtggggttgtttttgttttttaaacaaaagtggatcttatgggcattctggaaagctcccgcaggaagctaagaataaaattttgaattgagaagtccctttcttcaaaccacattcagacccaattctgctattctatttatttttcaaggggattagccttattttaacaccaataatcttatcacaaaaacctcccagaggaagaccctgtagattttgtaatgaccttaatcaagtattagccctacacttcaattaatccccaactgtacaaaacgtatgttcttttctctaaagctgtagcaagttgaaaggggattaaaaacggagggaagggaagagtgtttggaatttcaggcacagcaaacaggcacagcagaccaggaagagcgtcccgggaaaacatattatccagacttaagtttatattccctgtctctctcagacttttgcagaaaaatgagtcattcaacaaatatttgaatcgagatagggaaagtgacgaggaagaagtttgcacttatgaggttttaatttgcaattatttggctacctttttgccttcccaaaacatagggtctttaggagtgaaacttcatagccaaacttataccttgtccagcacagagaaggccatcaaaatgcctggtttaaataaaaatattaaaatgattgggagggtaaatcccttgacctataaatctgacctcctttaaacattatttgtatgttccccaataaactattccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccactcggtgaccaaatttgaaaaaaaaaaaaaaaccgcgccaacccatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctatycgccgtttggctcggcgcggtggcgtcaagcgcatttccggtcttatctatgaggagactcgaggtgtgcttaaggttttcttagagaacgttattcgagaygccgtcacctatacggagcacgccaagcgcaaaactgtcacagccatggatgtagtatatgccytraaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgayakcctgcataagaatgaattgtgtttgccatgaccggccmcactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagagagagactcctcaaaaaaaaaaaaaaaaaaaaaaaaaattatgtattttagagcattctaagaatggtactttggacttaaccgaagggctggaggcgcgtgttgaacaaaggttatcaccttttggctcatgcggcacacagctatgtaaataaagcatctttagggacaagctctcatttgcggagggttctatggctgttgtcctattggccaaaacaaagtggtctaagtccgggcgcggtggctcacgcctgtattcccagcagtttggtaggccaaggtgggtggatcacgaggtctggcgttcaagaccagcctggccaagatggtgaaaccccgtctactaaaaatacaaaaattagccgggcgtggtggcgggcacctgtaatcccagctacgtgggaggctgagccagagaactgcttgaacccaggaggcagaggttgcagtgaaccgagattgtgccactgcactctagcctgggtgacagagcgaggctccatccaaaacaaaacaaaacaaaaaagtggtctaataatccccagaactggaggaagaaccataacttattgattttgtttttaaccttatgtatgccaggcatgctagccttgtatacatacaaggctagaggagcaaaggtgcaggaagccatcttgagggagtcccatattattgagagaccggccagctgctgggagaggctagttgttcatcctcactgtatgtgatgagaatctggtgacagtccattgctgggcacagcatttaggcaaaatggctctctgctatgtcaggcaagtgaggcatatttttgcacaatcctagtaattccgaactcattgggaaacaatggcaattacatccaagcaaggaaaggtctgtggttgattttatctatacaaatttaaaacataatgtttacaacctttcattataggacacaatttttaaaaagatgccaaactatacaaataagttcagaaaagtgaggtactattgaaccgtctggaaaacataaatgtatgtgaaataatgcaatgcatagttttgcaggggactttgttcaaagtttctcgaaataccatggtccaaagtagactaacattagcattggttatttatgatgatcagtaagaatactaaatcaaaaatcaaaggaaaattaaactatgtctgtttaaagagaaacgtagtttacctcagactgagagttaaaacaagtttgtgattcaggaaggtggaattcagaacctaattgggcagcctccaacatttccattaaggtttggattcttaaaatttttcagtcttcggtatgctctggtagtctgatgaaacttacagattcttttcataaataagatacttaaagtaattcatagggttacaattgtattagaccaataatattaaaataattatcaaaccacttgaccgtaatatgtgtgtttttgttgatatacctaatagtacttcggaaataagcaagcacgatttccagattcttgcaacaactataacctacaaatttgttatttctatcagtcacacacaatggaagaaaattctaaatttcagctacaggataatgaatagatgaaaaacaacaacaacaacaacaacaaaaaaactcccctaatccatattctgggacaccttgattcctatttattgatcccttgaagtcagtggatagcatattaagaaacaatagttacaatgacaccacagaaagactagaatgtagtacttgtgttaaaaaaaaaaaaagtatcagcaagttatgtttggatgccaaattgctctccacttcccttccctgacactggcatttccagaacttagatgctcttacatgtaaaagcctcctctagtgcaccatcgagcttttcaggattggacatcagactttttagttcctggacctctagatatacggcagtctctgacaagaagccctttttctgttttaactttttttttttttaagttttgagacaacgtctgactcgctgtcacccaggctggagtgaggtagcaccatcatagctcactgtatccttaaacgcctgggtgcagggactaagggagcgtgccaaccatgcttgactaatttacttttttgtaaaaccagtagtctccaacctttttgacacaagagaccgttttgtgtaagacaattataccacggaccagggggtgcaggggctgggagcaatgatttccggactaaaactgctccaacctcagatcatcaggcattagattgtcacaaggagcctgaaacctagatcccttgcatgtgccattcacaatacagtttgagcttatgagaatctatctaatgctgcagctaacctgacaggcggtggagctcagttggttaatgttcgctcacccctcagctgtgcggctcaattcataacgtgccatggacagggaccggttaccggtcggtggccgggggaatgaggacccctggtatagatggtagtctggctatgttgcccaggatggtcttgaagcctggcctgaattaattctccaatctcaagccttttcaactcagctgcatcacaacttaaacctatagataactgtcacagaaacttgtttccagtgttacgccatcttaaaataatgtgggtggctcttaaaagagcctttgggttctttccaaattggcctcccggaaagctctttacttcttagatgtggcctttctaacattaacttcatgatgttgggtcaattttgacttcgaagcccttgccttcactgggctcttctgctgttgcttacccttggctcctttagcctttctcccgctcctaacagttttaggagttgtcgctctcggcttcttggctctcttattggttttagcagtctttggtgacttggagtccctggataaaaccagcttcttggtcttggcagaaactgactttttagccttgcttctggtagatttaggaatcaccttcttactaagcttaaaggaaccggaagcaccagtacccctggtttgcaccaggattcccttgttcactaagctcttgagggacagtttgatgcggctgttattcttctctacgtcgtagccagcagcggccaatgccttcttgagcgcaaccaaagacatacctactcgttcctgtgacactgaaagggcctcggtgatcaacttggacacagagaggttcggcactttgcgacttgcacttatcaagccagccggcttcctccctcgcttcttggttggaagtttctccatagcggctagaccagcactggcagaagctgcaggcacggtttcagacataacaacagagaaacgcaagatgtaataaccagcgaaaagcatgaaacacccgggcggcctcggggccttatatagggtagggcgcgctgtgattggtgcatcacctaggcaccgcccccgccccttggaggaggagtatttgtgtttgttttacccggaaaagttgagtataacaaaacccctctttacagaatctcccagggtctagtgctgaataatctgcggaaattcatatttgacatgacttttctctttttaatgaaaaatgaccctggatgccaaaactattcgagaaagccctcgattttcaatcaaattcacggagaggaacaaaacttccccttttccttgtaaattaataagtaatctttggcagaagacttatttcatctcttcagagtggtcttccaaatggatagcttcaaatcggtagaggaaagaaattattcacgccatgatttttatttaaaattatttatatatgtgagggaagtaacacagatctcttagctgtctaattgcggagtcagaagatgcttatagaattgtcaaaagactgcagaggatgtctttatttaggcatgtgcaatctaataaatcataatccacaggaacatgggttgtctgtaattaaaggtgctcccaagtccctgtagctttatagaggactctcaaggatggggtaatatcaagatctcacacattatgtaagattggccataatcaggccactctcatgaccggtgtcctcaactgagttttgcttctggtttcattaattgaagtcccctctatccccctgcccacccctacatccccagataaacagacacagtccctcccctaaattaactataaaacatgaggtaggaaccctagactcaagaacctactagaaactacagaccccatgtctaacaagactgggcgggttggctgggcgcagtgattcatgcctgtaattacagcacttcggaaggctggaggccaggagttcaagactaggttggcctggtccctactgaaaaaaaaaaaaattagctgggtgtggtggcacatgcctgcagtcccagcttctgggtagactgaagaggatcacttagagcccaggagcttgaggtcgcagctactgcactccagcctgggcagaccctcatctctgaattgcttaattaattaactgagctggcagatttggctgcatagctgtggggaaagggttgttggaataatgtccagtgtgctcccctgagcttctactggaacaggtctttgtgagaggcctggagataagagcttgctcacaaaggctgaggcctttctgggatgctgaatgagtttagtgtggccagagcatagggtctcagcaaaggaaaactccataagggccatttgtgaagatccccaaatacttgtgtgaaacatttggtagatattagaagttttgttttggtttggtttgagacagagttttgctcttgttgcccaggctggagtgcaatggtgtgatcttggctcagtgcaacctccacctcccaggttcaggcaattctcctgcctcagcctcccaattagctgggattataggcgcccaccaccatgcctggctaattttttgtatttttagtagagatggggtttcatcatgttggccaggctagtctcgaactccccacctcaagtgatctgcccgcctctgcctccaaagtgctgggaatacatgcgtgagccgccgcgcccggcagacattggaagtttttaagcagagaatttgttgtattgttgtagttgtcttgggtttagatttattgcataaacaatcatttttgagaagggcccacagtcagaagttgggagtctgttgcaatagtctcagaagaatggcaaagaccttgcctaaggggacagtgtggtaaaggagagagtctacatttgaaatatttctgaaacaaaagccaaaagataagacttcaaacttctgattgcaaagtgtgatagaaaagtttctttctctctgtctctctgttatacccatacacacacacatatgcacaaacacctgaaagaaaaaaaaattcagggaacaggccaggtagggtggctcatgcctataatcccataaatttgggaggctgaggctagtggatcactagagcccaggagttcacaaggccagcctaagcacatagcaagaccctgtctctacaattaaaaaattacccgggtgtggtggcacgtacctgtggtcccagttactcaaaaggctgaggtgggagaatcacttgggcccaggaggtcaaggctgcagtgagcatgattgtgccactgcacttcagcctgggcaagagcgagaccctgtctcaaaaaaaaa

SEQ ID NO: 10801 - DNA, 13675 bp, Homo sapiens
  misc_feature (1)...(13675): n = A,T,C or G, or insertion/deletion polymorphism (see Tables 1-2)
ccaccgcgcctggccttaaccatttacttttaagtcgaggagcttatcagagaaatatgagaagtatggacgccacacgtgacagagagaaaagtctgaaaatgccccttgcatccaagtggggacccggcctcgacctcccgaaatcatacaccaagtggggaagcccatcaaggcccgtctgtctagattcttctcggcctctctaagcacctaagcacacgcttctcactttcgtggaaggggcagggctcttcccgtcacagggggtctgacagactgacagagaaagagacagacatagaaagacagagatggacagagagagatagagagaaacagacagaaagagagagggagagtgagagagagagagagagacaaggagggagagagacacacagacaggtagagaaagagagtaagacagaagacagacacagtgagagagacaggcagagagagagagagacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatagagagagagagaatcagaaagggaggtagacagacagagagagagagagactgacggacagataggcagagaaagagagtaagacaagacagtctcagtgagagagacaggcagagagagacagagagaaagaaagggagagacagacagagagacagagagagaaagacagatggagagagagagagaaacagaaagagagagagacagagacagagacaaacagggaggaagggagacagacagtagagagagagacagacaggcagagaaaaagagtaagacagaagatatgcacagatagacagacaggcacagagagagagacagaaaaagaaagagacaggccaggcacaatggctcatgcctgtcatcccaacacattgggaggctgaggtgggcggatcaccaggtcaggagatcaagaccaaccttgctaacacggtgaaaccccgtctatactaaaaatacaaaaaatatagccggtcatggtggtgggcgcctgtagtcccagctactcgggaggctgaggcagtagaatggcgtgaacctgggaggtggaggttgcagtgagccgagatcgcgacacaaaaaaaaaaaaaaagagagagagaaagacagacagagacagagtagagacagagagaaacatacagaaatagagagagacagagagagagacagagagaaacagaaaggcagggagagagagagagacagaaagacaggcagagaaagagagtaagacagaagagagacacagtgagagagacaggcagagagagagagacagagacaaagacaaagaaagagaaagacagagatggacagagagagaggaacatagagaaacagagacagagagagagagaaacagaaagggagggagagagacagagagagaaacaggcagagagagacagagagaaagaaagggagagaaagacagagaaagagagacagagacaaagacaaagaaagagaaagacagagatggacagagagagaggaacatagagaaacagagacagagagagagagaaacagaaagggagggagagagacagagagagaaacaggcagagagagacagagagaaagaaagggagagacagacagagaaagagacagagagagaaagacagagacagacagagagagacagacagaaacagaaagagagagacagagacagagagaaacagacagacagggagggagggagacagacagagagagagagagacagacagacaggcagagaaaaagagtaagacagaagataggcacagacagagagacaggcacagagagagagacagagaaaaagaaagagacagagaaagacagagagaaacacagagagaaagaaacagaaagggagagagagagaaacagacaggaagggagagagagagacagacagaggcagagaaggagaataagacagaagacagatgcagtgagacaggcagagagagagacagagaaagacagagacagacagaaagagagagacagagagaaagagagaaacagaaagggagggagagagagacagacagagggacaagcagagaaggagagtaagacagaagacagacacagaagaaaaacaaccaccaagaaagttaaaattctccaatggtcggaagttcaagaccagcctgaccaagatggagaaaccccatctgtactaaaaacagaaaaattagcctggcatgatggggcattgctgtcattccagctacttgggaaggttgaggcaggagaatcacttgaacctgggaggcggaggttgcggtgagccgagattgcgccattgtactccaccctgggcgacaaaagtgaaactccgtctaaagaaaaaaaacaaaaacaaagaaagaaaagacagattggtgagatgcatctcaaaattttgtttgcagtccccgtactaaaaacggaaagaaccaatacatgacaaatatgaccaaagcataccgtgcccacacgtgtcatcacagcactatgggaggccgatgtgggaggatcgctggagcctaaaagtttgagatcacctcgacatgtgagatgacatctgtaataataataatcatagaagtttaaaaagggattatgtgtgcccagagcatggacaacaaagcgagagcacatccgtactaaaaacgattgatagacaggcaggcaggcaggcaggcaggcaaatatagaatgagccaggtgcagtgtctcacgcctgtaatagcagcagtgtgggcggccgaggcaggcaggcagattgcttgagaacaggagttcgagaccagcctgggcaacatgatagaaccccgaaccccatctcactcacatacatacatacatacatacctaaggaaaacatgagaaacaacataaaagtcaaccggtgtggtggtgcatgcctgtagtcccaggtaatggggatgggagagatcagaggcaggacgaccgcttggtcggtccaaagtgttgagtctggggtgatcctgggcgacagagacagaggaagacccttccagtaaggaaggaaagaaggaaggaaggaaggaaggaaggaaggaaggaaggaaggaaggaaggaaggaaggaaataaataagcaagcaagcaagaaagcaaacgatgaacatgacaatgacatagaataacccatgacaatatacaagcaaataagagggtatgaataaagttaaaaggtaattaagatcacaatcaattgtttttctccccaccccatcccaccccacctcaccccacctcaccccacctcacataagctggagtggagttgcgcgatcatagcccacgttagccactgcctcccgggcttaagatatgcctgtagtcccagctacttgggaggctgaggttaccagagcccagagtgagaagacaggcaggcccaaaaataaaaaataaataagcgaaaataaaaaataataaatgaaagaaggaaggaaagaaggaaggaaggatatacatacacgtgtatatgtaaatgaaatgggttttcatttaatacatattcatacattaaaattaacatttataatataaacgtattaattatggaaatatctatatagttttatcactacatatttatgtgtgtgtaagtatgtatgtgtgtgtgtatatatatatataaaaatgtatgtttatacacagcagcgtgcagaaaataagattgaaggaaaaaaggaattggctaggcgtggtggctcacgtctgtactcccagcactctttgggaggctgaggcgggtggaaggtcaggagttcgagaccagcctggccaatatggtgaaattccgtctttactcaaaatacaaaaattgctgttcgcttgaaccctggaggcagaggcaacggcagcagtgagccgagaaggcaccactgcattccagctccagctccagcctgggcgacagagcgagactccatccccagaaaaaggaaagaaagaaagaaaggaaaaaaagaaaaaaaaaaacacaagacaaaaccaaaaaaacaaaaggaggaagtattacttactgacggcaacagtgactctctcttaaaagtaccgtggaagcaaacaaagtgggtctgaaaaaaatgtaagagagggagttccgcgtggtcccagctccaccaaaggctgaggctggtgagggccacccacgcatgaatggggataggtgccctcacatgggtgagccacaccatccagtgggaccgccacaggccacctgctggtcaacctgggacacagggagccgccggctaagtctggagctcacgggcggcagctggtcaaccctggaggttcccaccaagatgcggacactctggatccggctcatcctgacgggcacccctgcacaccgcttggtccagaggtcctgctgatcggcatgtgacacagcgagccgccggctgtctcacaccctcgggcggcagctggtcgaccccggaggcccgaccgaggagcagccacgagtggagattggccatggtggggacgccctgggccttgccacgcgcttcccgccacctgcagtactggtcgacccatgtggaggaaagagaaagggcacgaaggccagaaccccaggtggccaccccacgggcccgcacggccacccctggggcaggggctggcaggctacagacccagctcggcacagccacctccacaggtccaccccatgctccccgagcaccttccagcccagagcagacaagccacctcggcagtgaacagggaggagaggggaaccaaagtatcggggcacgccggtggggacaagcacccccctcacccgtggtcggtgagaggtcaggagagaggaagatggatggtgccagacaagcccaccccaccgggccaccccacacacacgcggacaaacccttctgtcaagggctgacttacaatagatcacagagagggagctgttctgctacttatgaaactctgacccggaagcaggtcgtctatgaatggtttagtgccaacttccccccgaatgtatgctgcgtgacgggcgagtaggtagcctttccagccacacccttcccaggatgaagggcactctgcaccggacccagtcctggcacatggtgggacacacctaacccagggcgccgcagcccaccagcagggatggggaaccagctatccaaggccaaccaaggctccatgacgttgctgtatccttccacctgggtgggattctgacttagaggcattcagtcataatccaacagatggtagtttcaccccattggctcctcaaccaagcacatgtctgaacctgtggttcctctcatgctgagcaggtaccatggcaacacatcatgtagggtaaaactaacctgtctcacgacggtctaaatccagctcacatgccctattagttgaacaatccaatgctgggtgaattctacttcacaatgataggaagagccaacatcaaaggatcaaaaagcaacgtccttatgaacacttggccacaacaagccagttatctcctgtggtaacttcctgacaacctcctgcttaaaaaggtcagaaggatagtcaaagcccagctttcagtctgtattcccactgaaaatcaagatcaagcgagcttttgcccttctcctcacgaagtttctgtcctccctgagctcgccttaggacaccagcattaccgttcaacaggtgtaccgctgcaaactccccacctggcactgtccccggaatgggtcacacccagccagcgcacagctggacacttggcgccagaagggagagcccctcagagctcaccccctgcctcaccaggtcagtgaaaaaactatcagagtggtagtattccacgggcagcccacaggaccccacccctccccctcagggggacaggggatcacaggggacctcccacttattctacatctctcacatctcttcaccatgccagactagagtcaagctcaacagggtcttctttccccactgattccaccaatcccattcccttggctgttgtttcactggagagtaagtaggtagggacagtgagaatctcattcatccattcatgcacatcactagttagatgacgaagcatttggctaccttaagagagtcacagttactccctccatttacccgtgcttcattgagtttcttcattttgacattcagagcaattggcagaaatcactttgcaacagcccccaagggccttcgcgatgctttgtttaaacagtcggattcccctggtgcacaccagttctaagtcggctgctaagcactggccgaggcgctgcacggaaccgcagccccgggggcagggaccagccagcagcccgccaccgccacagaggtggggacaggagaaggatggggcccgggggaggtgggggaacgaaccaccccgcccaccacccacggacacccggtcgttccctgcccacgcggacatacacgatggtgcggagcgagacagggcacaccagcaaccaccaggctccccatgggcggccacaactggggtaatccacgggaatggcccaacttgcgtccagagtcacggccaacaccagccccctgggccccatcacgggaggtcatgccccaccaacagggccctatggccaccgccaaccccagggagggggaggacagggagagagggggcggggtagggagcggcacgcggcgtggggcaggggagggccacgacaggctcgccckgggcgtgggggggtggtggcacctcgtccagtggcggcacgcacccagcccttacagccaatacttatcccaaagttacggatccagcttgctgacttcccttacctacattgttccaacatgccagagtctgttcaccttggagacctgctgcagatatgggtatggccctgtgcgagacttacacagtctcccctggattttcaaaggccagccagagctcaccagatgccgccagaaccacgacgctttccaaggtacaggcccctctctcagggcgaacccattccagggcgtcctgcccttcacaaagaaaagagaaccctccccggggctcctgcatgcttctccaggatcggtcacattaccgcactggaagcctcatggtgcccatctctgccactctggattcagggatctgaacccgtctccctttcaaccggctgaggtcaatggaggccctcacctgtcccttcggaacggcactcacccatctctcaggaccaaccgacacatgttcaactgttgttcacatggaacccttctccacttaggccttcaaagttctcatttgaaaatttgctactaccaccaagttctgcacctgcagtggctccaaccgggcccatgccctagacttcaaagcttaccgcagcggccctcctactcgtcgcggcatagaatccgtggggctctgggggagggtgcaggagaggacccccaccacactcacacgggcataacgcccctgccgctcccgtccactctcaactgccagcaacggccgggtatgggccggacgctccagcaccatccattttcagggctagttgattcagcaggtgagttgttacacactccttagcagattccaacttccatggccactgtcctgctgtctatatcaaccaacacattttctcgggtctgatgattgttggcatcgggcaccttaacccggcattctgttcatcccacaatgccagttctacttaccaaaagtagcccactaagcactcgcattccacgcccagctccacgccagcaagccggacttcttacacatttaaagtttcagaataggttgagatcgtttcggcaccaagacctctaatcattcgctttaccggataaaactgtgtggggaggttaggtttgcgagagcaccaggtatcctaagggaaacttcagagggaaccagctactagatggtttgattagtcttttaccccctatacccaggtcgaaagaccgatttgcacgtcagggccgctacggacctccaccagcgtttcctctggttccaccctgcccaggcatagttcaccatcttttgggtcctaacacgtgcgctcgtgctccacctccctgccgcggcaggcgagacgggacggtggtatgccgtcggcagactggagaggcctcgggatcccacctcggccagcgagcacaccgcccttcaccttcattgctccacagcggctttcgtgggagcccctgactcatcaacgtgttaaccttggtccatttttcaagtagggtcgggtggggagacaacgtcgccgctgaccccatgtgctcgctccaccgagtgacgtccgcatggccccgagagaactcccccggggccgacagtgtgacccgcccatggcacactggggacagtctaccccacccctctatgcggtcccccgtcggtggggatgcatggaggcgggtgggagagcagtcacaccgtgggcggggtggcccagccccccaccaggagacacaggcgcacccccaagggggtgggcaccggcaagggagagcacggcaatgggtctcgctccctccgccctgggatttggctagggctgctgcggggggtctgtaactcaggaggttcggtcccaccactgccgccaccccgacccgcatggcctcccgagggaggacgcggggccggggagaagacggggaaggacggacggggcccccagacccacctttccccaccgggccttcccaaccatcccagagccagccacagtgcaccgctgtggtggaaatgcgccgggcggccgccagtcgccagttaggggatggtcacccaccgaccccggccctgcccgcccacaccaacccacctccggggaggaggaggggcagtcggggagggagggcgggtggagggttcgggaggaacttggggcgggaaagatccactgggccaccgacacggccggacccgccaccaggttgaatcctctgagcagactgcgcggaccccacccgtttacctcttaatggtttcacgccctcttgcacgctcttcaaagttcttttcaactttcccttacggtacttcactattggtctcgtgccggtatttagccttagatgtttaccacccactttggtctgcattcccaagcaacccaactccaggaagacccaggcccagcacgccaggggccgctaccagcctcacaccatccacagtcttggcctagatcaggacttgggccaccgacgagcagtgccagggactgggccttccatacacaacatttcccacaccccaccccagggcggggattcggcgctgggctcttccctcttcactcaccgttactgagggaatcctggttagtctcttttcctccgctcactaatacgcttaaattcagcgggttgccacgtctgatctgatgtcacgtctcggaggggaacgaggcaaatgggccggcaggggtgggctggtcagcggactgatgaaatgcaccagcctgcctgaccacccgacgctctgtcgggagacgggcccggctaagggagaggcgagagcgagagagccacggctgactgcacccctgccaccctgccacagcaggatgacgggagggaagggcacaggccaggggtgggacggccaccgcacacctccctgggggacaggtccaaggttgcagcagccgcaccgccccaccccaacgcggaagctcaggacagggacccggcatggcacggccacaagctggaggcagtcacgcgatggcagacgacaccacggcgtcccgcgaaccctgggaccgcagccacgagtgcgcctgggcgggccgcgaggtgggcttccagccccatacacgccacaaagcaagccaggtgggcaggcggcgggtgagggggacagtgccccataggggtggtagggagcaggggcacgggagcagcggtcagccagacaccaggccgccaccaggggcaggcagtgaaccacaacaaccaggacacgctccccgaccatctccctgccagacccttccagacctaccttcctcccccccacgacgcacccccaccactgacgaagcgcgacgacaatggcacgggaccttccacctggccagggccaatgaaccacgagccacgtgcagcacaaggtagctccaaagggaggaacctggaccacattggcagccacaggagctcggccagagccagctttcttccctctccatttttgtgggcggtgacaccaccatctctctcccagccgggccccccttccccctgccaccaacacgtgaccacacagggcccacagggtgagggggaaggggcgtgcgcagcggaagggcgaacatcgctgggtctgtacttggggggatggagggccccggcagaccctgcaagggaaccccctagccacacaccccaaggaacccagaggcacccccaggggcaattgatcagcaagtgacgctcagacaggcatagtcatgtgaggaacccagggccacaagtgctttcgaagtgtcggtgatcaatgtgtcctgcaattcaaattatcatagctagctgcattctttgatgcacgagctgagtgatccactgctaagagtcctatgaggtcgatttgggttctgagggcctcattaaaccatcgacttggtattagcgactggctgtgtggtacaaagggcagggacttaacgcaagcttatgacccacacttactgggaattgctcattcatggggaataattgcaatcccccatccccatcacaaatgaggttcaatgggttacccgcacctgccagcatagggtaggcacacgctgagccagtgtaacacacatgcagccccggacatctaagggcatcacagacctgttactgctcaatctcgggtggctgaatgccacttgtccctctaagaagtttgaggacgctgaccactctggggtcgcataatgagttagcatgccagagtctcgtttattatcggaattagccagacaaatcgctccaccaagaacagccatgcaccaccactcacggaatcgagaaagagctgtcaatcctgtccctgtccgggtgaggtttcccgtgttgagtcaaattaagccacaggctccactcctggtggtgcccttctgttaattcctttgtttcagctttgcaaccatactcccaccggaacccaaagactttggtttcccggaagctgcctggcaggtcatgggaataatgccaccacatcaccagtcagcatcgtttatggtgggaattatgacggtatctgatcatcttcaaacctccgactttcattcttgattaatgaaaacattcttggcaaatgctttcgctctggtccgtcttgtgccggtccaagaatttcacctctagaggtgcaatatgaaagccccccggccgtccctcttaatcatggcctcagttcaaaaacccacaaaatagaaccacggtcctcttccattattcctagcttcagaatccaggtggctcgggcctgctttgaacactagttttttcaaacacttcgggccccacaggacactcagctaagagcatagaggtgacaccacccgtccccaagatccaactacgagctttttaagtgcagcaactttaatatacgttattggagctggaattaccgtggctgctggcaccagacttgccctccaatggatcctcgttaaaggatttaaagtggactcattccaattacaggccctcaaaagagtcctgtattatttttcatcactacatccccaggtccggagtgggtaacttgcgtgcctgctgccttccctggatgtggtagccatttgtcaggctccctctctggaatcgaaccctgatgccgtcatccatagtcaccatggtacgcatggtgactgccatcaaaatttgatagggcagacgttcgaatgggtcgtcactgccacagggggcgtgcgatcggcccgaggttatctacagtcaccaaagccgccggcgcccacccctcggctgcggccaaagaggggctgaccaggttggttttgatctgataactgcacgcatcccctgtgaagggttcagtgcctgtcagcatgtactacctctagaattaagttatccaagtagaagaagagcgagaaactaaaggaaccataactgatttaatgagccattcgcagtttcactgtaccggccatgcatacttagatacgcatggcttaatctctcagacaaacatgttactggcaggatgaaccaggtaagtaaagcgcggtgaggccccgacaaggccaaggccttgcaagtaggggcccagcaccccggacgtgaagatgggttgcggccgggctggcggcagggcatgggcgcggggcggtaggtgggaggtggggcatggaaaaccggacaccccacccacacgacacaccaccaccccccaatgggctcaccaccaccgacccttctcgtccacatgcgaggaggcggaccgcccgacccgtgcccagcagccgcgatgaactggcggccatgcgtgcgcacagcgggtgcagggcggcggcgaggagacagtgctccccccgccccacggggcgccctgacgttcgggtggagagcgagaagcggaccacggtgccgtgcctggcaacagtcgtgctgtgtggccgcagcacccacacacctgtcctggtcaaggcccggctccaatccccaccgaggggcacaggcgcaggggttgcagacaccacacgacggccaaaggagagcgaaggaagccggctggcatgctcacccccacccccgacccagggaaaggccgagcgaccagcaaggcagagatcaaacttcaccccacatcgcaagaatgcct

SEQ ID NO: 10802 - DNA, 12815 bp, Homo sapiens
gccattctcatcactgtggttttaatttgtattttcctactggataatgatgttgagcacctattcatctgcttattagcccagtatttatcctcttcagtgaaatgtctgttcatgtcttgctcattgcctgttttgtatttggatttcatttttattgttgtttaaaatttcttcatatattctgaatacagtctttacagaatatgttgcctgcaaatatcttctctcattctgtagcttgtctttttatgctcttcataggtctctcacagaacaacagtttttagtgttgataagatccaatttattaacttttatggatcatacttttggtgttatgtctaagaactctttgtccagtcttagctctgatgactttttcttaaaaggtttgtaatttaaaaatttaaatttattatttattttagaaaaaaaattcttgcctaggctggccttgaactcctgggctcaagggatcctcccacctcagcttcctgagtagctgagagtacaggcctgtgataccacacctggctcaatgtttgccattttaactctgtgctttacatgaaagcttgtgactcattttgagttatttttgtatgaagcatgaggttttggctcaggttattttttttccactgtggttgtccagttgttccatcaccatttgatgggaaagctctccttccttcattgaattgcttttgtgcttttgtaaaagtcagttgagcatgttttgctcatttttagttgagttgctcatcttcttacattgagtttaagaacttttcacatattctggatacatgttcttcatcacagatgtaatttgtgataaattgtgaaatattttctctcaatctacggcttgtcttctcattttctcaatattgtcttttggagtacttaagttttaaattttaactaagcccaatttgtctctcacttttttttcatctgtagatcatgttttttgtattttatgtaagaatcttttgcctaactactcaatgtcacaaaaattttctcctatattttcttttagaaattttatggttttaacttacaaattttagctgtttaggtctctaatttgtttgagcttatattttatatggcgataagtgtcacatcatattacctatgcaacttcattgaagatcaattgacaaaaaaatgtaagaatgtctttctagattctcacttctgttcattaatctctgtgtctctcgctttcacactgtctggattattgtagttttatatgacattccattttttttcaaatttgcgttggcttttctgcatcctctgcattttcacatacatttttaggattaaattgtcaattttccataaaatgcctgctggggttttgatagagattgtacagaacctatagatctcttggtggagaattgtcatcttaacaatattattgagctttccaaccgcatctctccatgaatttagacctttaatttctctcagtaatgttttgtagttttcaacaaactctgctgtcttcctaaatttattcctatttctctctttttgtaactactgtgataggaaagtttagattttaattgcttgtatagagaaatatgttaataatttttaatttgattttatatcctatgggagcttctggattcattttttagtgctagcaggcttttatctgcttgtgaattctacagacaaggtcatgttatctgtgaatagagttttatgttttcctttttatctggatgcctttaacttttaattatttgccttattgcaccagctgcaatctccagtacaatgttaagtagaagtgttggattggacatccttgcattgatctccatcttaggagaaaagcattcagtctttcttcagcaagcatgattttagttgtgggttttttatagatgccctttatcagggtgaggaaggtcccctccattcctattttgttgaaacttatgaacatgagtggtgttaacatttttgtcaactgtttcttctgtatcttttgagataattatgtcttttattcccttactacagtgcattccattaattgatttctaattgttaatccagccatatattcctgggatgaatcccattggtcatggaatgtaatccttttttacgtggctttctattgtctgccaatgtttgttaaggatgttttcatttatgtttattggtgacactggtctatggtattcttttcttgtcagtcttgctctgactttgatattagggtaatgtcagttctgtaaatgagctagaaagtcttgcctcctctcttcttgtctgaaagagcttttgaaatatttgatagaattcaccagtgaagatatctgggctttggcatttctttgtgagaaggttttaaaattactgtcttagtgtacagttctcttcagattttctatttatttttgagtcagtttcagcaatttctatctttgtataaatctgtccattttatctaagtggtctaactgattggcttcaggtttttcagagtattaacttataatgttttttaacttctaaagggtcattagtgatactctctcttgtgttcacaattttggtaatttatctcatttctcatactgtctgttttgacttttggtcaagaaaacagacagaggcagctctgtgacagattctgtagtgggaagctttgatcattcatagctggcaagccagactaatgccagcaaccccaaaggagctgccaatggatcttgacagggaagtcactgactctggattgggctatgatcaaccaggggtagatgtcaatgcttcaaaggctatacaagaaccagaaaaatggagattacaccaatttggactgttgagtcacatttctttacacaagaaaacacactttacagccttaaaaagccaacagtgcacagggaaatgtactattcaggggaaactttgatagaatattgaaatggctgaccaggcgcggtggctcatgcctgtaatcccagcacttttggtggccgaggcgggcggatcacctgagtttaggagtttgagactatcctggccaatatggtgaaaccccgtctctactgaaaatacaaaaattagctgcgtgtggtggtgggcgcctgtattaccagctactcgggaggctgagacagtagaattgcttgaacctgggaggcagaggttgcatgagccgagatcatactactgcactccagcctgggcgacagagtgagactccatctcaaaaaaaaaaaaaaaaagaaatagtcagttgaaacattggttgtctaattgtctaaaaactgccaatataattgttgggcaatataaacatgaaggactggcttttatatcttcatgaatgtgcttactgtcaacatgggtggagctgcgaaactgactccactaggtagcttcctctctttttcctgatggatcagggtgatgctgttatgactgtacatacaattcttcttaaggggaggatgctggaataatgactacacttcatttcttatttctttttttacacagggtgcagtggtaccaggaacagggatgcaaatcgaactgccagaaacaggaattatccctaaggaaaaaaccataactatatttttatacctttatgtaagaattcccaagcaaatcaaggattgcgctgtgccttcatttcatctggcaaagtcgggattaactgtaagtagagctacgtagactggtggtcagatagcctgcactagttcctaacctatgtaacctactgtctatgatcaagagtagattaagagaagacatggtagaatactattgctgcatgcagtctaggccagcacagcagccaaacctaatgtcacttctagaactggaaaagactgatataaagggacagaaggaggaatagtggctgagggtaggtgaataaatcaaagggttatgtaatgaggaaaattcaatattagcttatctcctcaaaagtggtgtgagcaagagatgttgtctcttaggtcaactatactggatgcctaaaagggtgaagctgtatgtccctgagaccattcttgtttttggaacctgataagattgaatggtgtctgcaaagctgagtgatgtcattctgggagacatattcatacaagaggatgataaactggcctaattttgaatgaccgaatgagacttggataatatgccaatgcttctttactgttataatccttttcgtatgaaaaatatgtggtcaaagaaaagggggtaatatgagttatcacaaaaacatttagttttgtccctggtttctcctaaaaaccttagaatctcttgagtgattagagtgtctttagaatactgaggaaaggactcttggctgagtggatcctggataccttgagaatgggggctggctgccacagacacatacctatgatgagagggttgtcttattccgttttgtgttgctataaagaaatgtctgagactgactaatttatataaacaaggttcatttggctcaggattctgatgtctggaaatgtttgagcatttagcgagggcctcaggctgcttccactcatggcagaaggcaaaggggagctggtatgtgcagaagtcacgtggtaagagaggaacagagggagtaggaaggtgcgagactcttttaacaactagctcttttggaaactaatagggcaacaattcattgactcccgagagagggcagtatctctctgttcataaaagattggcccccaagacccaaacgccacccattaggccctaagtccaacattggggatcagattttaacatgaggtatctggggataaatatttatatcattgcatcctgtccctagccagccaaagctcacattcttctcacattgcaaaagacaataatcttctcccaattgtccaaaatgtgttgggttgatccagcatcaactctaaattccaaagtctcatctgagactcaaggtaagttcttatagctgtgcacctgtaaaattaaaaaaagttatttacttctaaaatattaatacaacagtggtagagacatttcctatacatttccattccaaaagaaataaatggaccaaaagaaatgaatgcagtgtcctcacaaggttgaaactcatcatggcagacattaaaacttaaagctctaaaataatctcctttgactctatatcttgaaccctgagcacactggctgctgcaagcaatggactcacaatgccatcttcagcctcatatccgtggctttggtgaacataatccatatagctgctctcatgggtgaacattgaatgcttatggcttttccaggctgagcttgcatattgccagtggctctatgatttagtagtcttggcaggggtcctgttcctgcagctccactaggaattgtcctggatattaaatttcccctttaaatatcagttccagtttcaggtcatgtctttgctcacacatatgtgcataggctattacaagcaggcaggccaaatctggaatgctatgctgcttagaaatttcttccaccagatacccttatacatcactctcaagttcaaagttctacagatccctagggagggggaacaatgcctccaagttctttgccaatgcataacaaaagtgacctttcctctaggtcccaataagttcctcatctccatgtgagaccttatcagcctggactctattgtccatatcactatcagcattttggtcacaacagcttaacaaatctctaggaagttgcaaattttcccccattttcttgtcttctgaactctccaaactcttccaacctctgcctgttacccagttccaaagctgtttccacattttcaagaatttttatagtaatacccaactcctggtaccgattttctgaattagttcattctcacacttttataaagaaatacctgagactgggtaatttataaacaaaataggtttctttctttctcctcccaccatccaagatgccaaaaggaaagaaggccaaggagaagaaggtggctccagcccctgctgtcgtgaagaagcaggaggccaagaaagtggtaaatcccttgtttgagaaaaggcctaagaatyttggcactggacaggatatccagcccaaaagasacctcacccactttgtgaaatggccctgctatatcaggttgcagcagcagagaaccatcctctataagtggctgaaagtgcctcctgagattaaccagttcacccaggcaccagacagccaaacagctactctgctgcttaagctggcccacaatacagaccagagacaaaccaagagaagaagcagaggctgttggccygggccaagaagaaagctgctggcaaaggggacattccccactaagagtccacctgtccttcgagcaggagttaacaccatcrccaccttggtggagaacaagaaagctcagctggtggtgatwgcacatgatgtagatcccatcaagctggttgtcttcttgcctgtcctgtgtcataaaatggggtcccttactgcattatcaaagggaaggcaagactgggacatctagtccataggaagacctgcaccactgtcaccttcacacaggttaactcggaagacaaaggtgctttggctaagctggtggragttctcaggaccaattacaatgacagataygatgagatccgccrtcactggggagacagtgtcctgggtctcaagtatgtggtttgcattgccaagctcaaaaaggcaaagggtaaagaacatgccactraattgggtgaaatgtatgctgttgagttttctgtatgtaaaaataattaaaataatataaattttccttcaaaaaacaaaaacaaaacaaaaacagaaaagaggtttaaattgggtcatggttctgcaggctatacagaaagtatgattctggcatctgctcatcttatgagagggcctcagggaactttcgattatgctggaaggctaaggggaagcagacattacttacatgcctggagcaggagggagagagagcagggaggtgacacagatttttaaacaccagatcttatgagaattatcacaagaatagcaccaaagagatggttctaaaccgttcatgaaggatccatcctcatgagccgatcacctgccaccagacaccacctccaaaattagggattacaattgaacatgagatttgggtggggacacagatccaaacaatatcaggggtcatggtggacatgaggatgggctggtctcccatttcttacctgttactgtagacatagacacattcagacgctttggcagaaagagaagccagaggcccttaatgtcacaaagaggaggcatgaacaaatcttgcatctcagtccctcacaaggcaatcttagaaaaaacatagtcataaactaatccaggtcagtcacagtaagttgtgacactgaacagcccaccacaccttgaaaaattccaaatcaaagaatctccagagcttagttgtgtcccctctgcccaactcctctttcacttcaggccctctaaggtgtcacttttacaagccgtgagagacacatcagagccctgggtactgttcctgtttggggtggaacaaaaacaaaatctggtcagagcccacaggtgatgtgactaaaggaggaattttggggtggctgagctcccccatgggctcctgtctacactatcccaaggatctcagggatcactcttcccacccctaccacacttacatgaagcctgagcataactgcctccttttccatctgtggaaagaaaacaaactgtgagaggccagggaggaggcagggcatgagatcctagagaagtttccagaactgtgactacagacccaggtcaggatcagaaaacccaagggaagaggatgtgttgaggctggaccagttgtcctcctgaggtctgtcctcagcagggaccttcccctgacctgtgactgctgggagtcaggttcccatgaccacaatcaaggtgataaatttgtccttcattttcacaggtgctttacaaaagagtaagtgttgatagacagggcctctgaacagggtaaatgtgtgtggagatggtgcctcacaactaggcaagatatgagcctactcctacctggggcttgaaatccaccaatggaagaaggaaactcagagctcacccctttcctacctgggatcttattcctccacatcacagcagcgaccacagctacagtgattacagcaactagaagaaccaggccagcaatgatgcccacaacggggatgatgggctgggaagacagctctaagaaaggaggtgaacgtgaggggccctgacccccaggcctcagccctgaccctgcttaaaggctccagaaggacttctgctttgcctgagaagagacatgacccctcattcgtctccttaccccatcttagtgtgaggggctcaggcaacccctcgtgctgcacatggcatgtgtacctctgcttctctccagaagacaccactgcagctgcccacttctggaaggttctgtaccctgcaagtctggtctccacaaactctgcatcctgaatttggtcctccccatcccgctcctgggtcagtgtgatctccagagggtagaagcccagggcccagcacctcagcgtggcctcatagttggagatggggtggagggttacctgtgccttcaggggatctgagggcaagaggtagaaaattcaggcactttgcattcctcatgagacacagcacccatgtgaccatcctgagaatggatgggacatctggggtggggaagggagcacagaacccagacaacattctggacacaggcacctgggataatctcttattccttggaaagttctagtgtctgaggcggaaacagagatttctggtcctgacctgagtggaggccgagggactcagaagagctggaatcagacccccacacacattgagtatgaggcagagaacaaggcctgagaggaaaattcctggtgcccaaggctgctggggggtcaaaggggaccgcgtatcagtattccagggattgtcttcccctcctttcccgcagagacttcatccgttaattgtcccagagtgcagggcgggccctcagtcactctctggtataggatttagaaacccaggaggactcttctgcctcaggacaagagggagagggatattttagcgttggtcccattttcctccccttcttttggaaggtggctcagggatatctgcaggagatcagggaggcgacccgtggcctctggtacctgcgcattgcagcctctccttctcattcttaaggcctttgctgagccactccgcccaccttcccggcaggtaggttttgagcagctctgcatgttcctcctccaaaacatctgagccgccttttccgctgcggtccaagagagcagttcctggtttaggacgaggtaactggcgccatcgtagggtatgttcatccccgcgcgaagaggctccggtccgggtccaggtcgcagctgtgtatccactggaggtgggagaccctgtccccaagcccgcggtcagcctcagccactgagctcctcctctgccccgatcaatcccccggggatttgggcctgaactgaaaatggaatcgggtataggcacctggggttcttgtgtcgagggtctccacgagtcccgcagcctcggcgtgggtctccgattgtgctacagtgggtagcacaatcttggtagcccctgaatggtcacgaatctaatttgtaaaagagatgatttttggccccattatatataaatatgtctaaacgcattgcaattagactcacaaagtgaagttttactttcccagactgtgtatctgtgactctggtctgttgtatttttacagtatctttatttcatagctctgagtttgtgtgtgcgagtccaggacatctcaatacaaagcacaatgtattaccgtatattgcaaccaggagcctgtacagaatttaattacctcagaattgcaagtgcttaatgcagccaaagtgcccttcgccagtgctcatgcactccctttattattaatttttttattttttatttatttacagacagggcgtcactctgttaccctggctaaagtgcagtggcacgctcatgactcactgaagcctcgacctccttggctcatgtgatcaatgctcctccctcagcctcccaagtagctggcaccacaggcttgtgccaccactcctggctaatttttctaaaaataatatttgtagagatgaggtctccctaaattgctctggctggtcttgaactcctgggctcaagcaatcctcccgcctcagcctcccaaaatgctggtattacaggcatgagctataatggccggcccatgcacttgcctattattatgaattattcacatctaagctatgtgtatattttattgagacatttggtattcttttttaacctttttttttttttttgagacggagtctcgctctgtcgcccaggctggagtgcagtggtgcaatctcgctcactgcaagcaccgcctcccgggttcacgccgttctcctgcctcagcctcccaagtagctgggactacaggcgaccgccaccacgcccggctaatttttttgtaattttttattagagacggggtttcaccatgttagctaggatggtctcgatctcctgaccttgtgatccacgcgcctcggcctcccaaagtgctgggattacaggcgtgagccaccgcgcccggccttttttaacctttttatcttagagaggcaattaggttttagacagccccacagaatgcattaaagaccaaggtgcaagtaacactgtgccaggctttgcggataaatgcattaaaaatctataaaacactgtatttaagtctgagaattccattgctttagaattctttctctctgttcctttacctcacctcctgcttctccagcccttctctctgtccctgtcatccttcaggccctcctctccccttagtctctactactctgtcactactgaattgtgtccctagctctgtcccttgcctgctgcccatgactgttctccccacaaaggtcagcaatcctgctaatgtgagtcagattgtttcatttcttcacttaaaagcctctaatggctccatcttactctcaagaagcctctagaatggaaggcacaagcacaggggctttgggttgttttgatcaaagttgtatctacagaatataaaagtatatctgccacatagtaggcactaagttaatttttgttgaatgaatgaatgaaatataattgtgttcaaaattgtatcacacaaaaatcatgaaatggaaaatgcaaagcaagttaggaaatatttggttttatgcaactactatgcatatcagttcatgaattcattccggtggagaaaatgtcatatacttatcctttgaatctgtttatttatttcctggcagtacataaccaattaccacaaacttagtggctgaaaacagcacccatttatttgtctacatttccttcatcagaaatccaggcctaatgtgatagactctttgttcagagtttcgcaaagctgtatcctcatcttaagattggggttctcccccaagcttgtgtagagtttgttggcagaattcggtttctggcaattgtaggattaaggtccctgtttccttcgggctatcagagtagacagtggggagggcttctaattcctattggccaccagtgttctttccccatgatccctccattttcaaagcccaaagtggaggaagcccctcacgctgaatccctctcacactgtgagtctctattctcaggaagaacccagtccttttcagagcttacctgattaggaccgtctaagcaggataatcctcatcttaaagtcaactgactggggactttaaatatatctgcaaaacctcttcacagcagcacctgctttagtgtcaactgagtaactggggtaacctgagtaaccaagggtggttattggggtgtcatcatagaatcagcctagcatagcctggatcttcctttcatgtttaaatagaacatacaagttgaagatcaaaaaatagatcattgttaatgataataaaatatatcttatatagccatggaaatttttattaaatattaaaagcaaatgacatgtttaatatcttataatgaatttagagcaaatgaaaaagttcagtgattcatcctctcttgtgaagctgtattagttatctactgctgcataacaagtcacctacaacttagcagctcaaatcaacaaatatttatcatctcccacagttatccatggtcaggaatccaggagaagtttctctgaatgcttctggctcagggcctctcacaacgttgcagtctagttgtcttccagggctgaatcacctgagggctcaaatggggccagggattcacaagacacaagaatctctcacatggcttttggaagaggctttagcttcttattgtctggtcccaggaggactcacttcctagtcacatggaccacaggcctccttatgacacaacagccagcttcccccagggctcatgattccagagaaagaaagaaccaaagtagaaacttcagtgagtcttatgttctacacccagaatcacaaactattatgtcagcattactctatcagttagaagtgagtcattaagtccaggccacacgaacagggagggaatgaagctgc

SEQ ID NO: 10803 - DNA, 13673 bp, Homo sapiens
  misc_feature (1)...(13673): n = A,T,C or G, or insertion/deletion polymorphism (see Tables 1-2)
tcaggaggttgaggcaggagaatcactttaactcagggggcggaggttgcagtgagccgagatcatgccacttcactccagcctgggcaacaagagagaaactccatctcaaaaaaaaaaaagtttttaaattgacaagtagtaattttacatatttatgtgatacatagtgatgtttcaatatgtataatgtatagtgatcagatcagggtaattagcatacccgtcatctcaaacatttatcatttctttgtgttgggaacattcaatatcttccttctagctatttgaaattatattattcttatgtatgctcatcctacagtgctatagaacactagaacttattcctcctgtctagctatgacgttgtatcctttaacaaatctctcccactgggcacagtggctcacgcctgttatcccagcacattgggaggctgaggcaggtggatcacaaggtcaggagttcaagaccagcctggccagcatggtgaaacacccgtctctactaaaaatacaaaaattagccaggcatggtggcacgtgcctgtagtcccagctactcaggaggctgaggcaggagaatggcttgaacctgggaggcggaagttgcagtgagtcgagatcgtcccaccgcactccagcctaggcgacagagcaagactctgtctcaaaaaacaaaaaaatctctccctatcttccccttcccactatgcttcctagcttctagtacctgctgttctactttttacttccatgaggtcgacttttctccagatatgagtgagactatgtgttgtttaattttctgttcctggctatttcacagaacataatgtcctccagtttcagccatggtgccatgaaccacgggattttattcctttttgtggctgaataggattgtgttgtatatttgtatcatagtttctttctccattcctcggttgttagacacctaggttgagtctgtatctcggctattgtgaatagtgctgcaataaacatgggggtacatatgttgatatgctgatttcctttcctttggataaatacctagtagtgggattgctgggtcatatggtagtggagttctatgtgtaggcttttgagaaattgcaataccattctccatagtgactgtactaatttatattcccaccaacagtgtataacagttcccctttctccacaaggtcaacagcacttgttattttttgtcattttgttgttattgtagcgatcctgactggagtgagatgatacctcattatagttctcacttgcatttccccgatgattagtgatgttgagagaacaatgaagtcatttttttcatatatttgttggtcatttgtatgtcttcttttgtgaattgtctgttcagatcatttgcccattttttaaattggattgtttgtgtttttgctgttgagatgtttgagtttcttgtatattctggatattaatcccctgtcaaatgaataatgtattagtctgttctcagattgctatgaagatactacctgagactgggtaatttataaacaaaagaggtttaatttactcacagttccacatggctggggaggcctcaggagactttaaatcatgtcagaaggcgaaggggaagcaaggcacgtcctacatggtggcaggagagagagctcatgcaggggaaactgcaccttttaaacaatcatatctcatgacaactccctcgctatcataagaacagcatgggggaaactgcccttacgatccaatcacctcctgccaggtccctcactccacacatggggattagagttcaagatgagatttgggtggagacacagagccaaaccacatcaaatactttgaaaatattttctctcattctgtagattgtcttttcaatgtgtcgattgtttcctttgctgtgcagcagctttttagtttgatataatccaatttacctatttttgcttttgttgcccatggttgtgagatcttatattaaaaatctttttgtaagatcatgaaaatgtcctgaagtatttcccctgtgttttcttctagtagttttacagtttcaggttttacctttagatctttaatccatttttagctgatttttgtatagggtgagaggcgaaggtctaatttcattattctgcatatgaatatccagttttcctagcaccatttactgaagagactatcctttccccagtgaatgttcttggcatctttgtcaaaaagcagttggctatcgacgcatggatttatttctaggttctctattctttttttttttttttttttttttttttttgagacagagtcttgctcttgttgcccaggctggagtgcagtggcacaatcttggctcactgcaacctctgcctcccaggttcaagtgattctcctgcctcagcctccagagtagagtagctgggactacaggtatgcaccaccatgttcgtctaatttttgtacttttagtagagatggggttttgctatgttggccaggctgatctcgaacacctgacctcatgtgatccacctgcctcggtctcccaaagtgctgggattataggcatgagccactgcacctggccctaagttctctattctattccattagtctacgtgtctgtttttatgccagtgctatgctattttggttactagagcttggtagtatatttagaagtcttgaaacctgttccctccagctttgttctttttgttaaggattgctttggctattctaggatgtttgtggttccatacatattttaggatttattttatattactgtgaagaatgtcactggtattttaatagggacattgactctgtagatggtttagggtagtatggtaattttaacaatattaactctttccatccatgagcatgggaagtttttccatttgtttgtatcctcttcaatttcttttatcagtgttttgtagttttcaatgtagaagtcttttatctccttggttaaatttattcctaggtatttatttgtagctgttataaatgggattgccctcttggtctctttttttaactagttcattgtgcatagaaacaccactgacttgtatgtttattttgtatcctgtaactttactgaatttctttatgagttctacaggtttcttggtagagtctaagtttttctctacataagagcttgtctgcaaacagggtaaatgtgacttcctcttttccaattttgatgtcctttattgttttctctttcatgattgatctaactaggacttccagtactacgttgaataagagtgggtaaagtgagcagcatgctcatggaggggcatggaggctccctagcctttcctctatatcttgtttcagttcttagaggaaaagttttcagcttttcaccgttaagtatattgttagctgtgggtttgtcatatatgatctttattatgtggaggtgctttcctttcatacataatttattgaaagtttttatcataaagtggtgttgaattttatcaaatgctttttctgtatctactgagattaccgtatggttttgtccctgattctgttgatgtgaagtatcacatttattgatttgtgtacattgagccattcttgcattcgtatgataaatcccacttgatcatgccacattatctttttgatgtgttgttgaattgggtttgttagtattttgttgaggatttttgcacctattttcatcaggaatattggcctgtgggtttctttatgctgtcttgttattgtctggttttggtattaaggttatgtgggcctcataaaagtgagctaagaagaattcctgccgcatcaattttttggaatagtttgagaagaattggtattaatttatatttaaagggtcatagaatttggtggtaaagccatatggttctggacttttgtttcaggggagactttttattactgattcaatctccttacttgttattcgtctgttcaggttcttctgtttctttttggttcagtgtggtaggttgtatgtgttcaagaatttatccatttcctctaggtttttgaattataaaggatatcacaaaggatacagaggaagaggtgcataaggtgagatatggggaaaggctagagagcttccatgccctccatgagcatgctgctctccaacaacctctaagtgttcagtggtagccacctggaagctctgacttatatattttaatttgaaatttctgttcagttttgagtaattgtctttttttagactaatttctaattatttccattatagtctgaaactatgtcctttgtgatgtaattctttaaaattttgttcagactttttttatagcctaatgtatagtcactttttgtacatgttttatttgtgcttgagaaaaatgtattcctctagtttttctatgcagacttctgtatattttaattaagtcaagcttattaatcataatgttcaaattacccatctctttactaaatttactactctatcaataatttgaatgtataaagtatagaccttctatatacccataaatctttccccttataaatgtcagtacttgagcctgccacaatgttgactagactgctttaacagaaagcctccatcacataataactgaaatacaatatactttttatttcttgctcaaataataattcaaaatgagtattctaaaacaatgggtatccttttttcatgtgataaaagaagtcaaggacccaggctcctttcaccttttggcttcactaggctctagaaccttgttgtcatctatactgagctggtggaaaagaaaaagagtgtgaaagagacttgccatcttcttagggtcttgacctagtagtgacaagtctgttagccaaaatatttacattgtggcactggctgcaagatgcttgggtaaggaaaatgcagcttctatttgagatgatgattctcctctatataacccctctttgctaggatagttatgacagtgtccagtctctaaattgttcatttatgagtggacaaaaagaaaaactaggaaagagagagcctttgggaagggtcaaataccactctgtaaactataggtacaaatatcagaatttttgaattataaaggatatcgcaaaggatacagaggaaggtgcataaggtgagatatgggggaaaggctagagagcttcctttgaatgtaaattacaactgtggactgaaggagtctgcattaggagttcagaatgtcagaaagaggttcaaatctttagaagattatcatcatcagaggaagagggtgatcttcttcccagcttgcatgcctactgggagtccagtgaccctaggttgtcccctctttctcctgttagggaagaagaaacatcttcacttctgagagttcatttccttcatgatattcaaggtcagtgaccacctcctcctggacagcctgccaagcctttgactgataggtctctccccctgtctgagctctaagatatttactatgtttctccactagcccttctgtcccatgccctacaatagtctctctttctgtgtgtttatgtgtgtttaaatttgtatatgtatatgtgtgtatgtgtttatatacatttatatatgaaacagctacttactctttcactcaggaattctagctctcttagtctaaagaaatcaaagatttataaataaaaataatatgacattctctagattattagtaattagtacaatacaaatacttgattattagcatttgagagctgtgcaattatgaaaatccacattttgagaaatacttacatgattaaataagggtggcaaaaatagataacaaaagttgtttatattaaaaggattgtttatattaaatatggagagaaactaaaagataatgcaatgaaacatcagttaattctaagcaactctttttaacaatatattttttcttttcttttttccataaaacattttgtaattagaaagcagaaataaatgatatctttcattctatcggcaagaacacaagactggytatgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagagtaggtgatgggctgctggatgggtgagggggaattgggtagggggaatggagggcctgtgtccagtctgagtaggacctaggagttggaaactctctgcatatccagctctgaccacaatgttgtgtagactctggactgtccctaaaccatggccctccagccccttagctggccctgggaatagtaatgggaatgangaagaaacctgcatattttgctgttccttctcaatacttagagagaaatggcacatcccatagtgaaaggcgcaccagggctgagaatccagtggggaaagcaagacaattattatttgatttatgcacatttgtgaggagtaaagattcagaagtggttatgacggtaggtgtaggtgtagaatgggtataagtgtagggaaataggacataagacaagcaaaagttggggtacacagagccaanttaaggttatcatcaaaggggcaaggagagtggtggtggaaagggaactaaagaaggggcaggaagactagagacagtgacagtgagcagaagagagggagagacaagaggcawgttgatcctcatctctgaattctactattcagagactaggagagagtttgaaagatgtctcatgcttctttgagctctcaggatcagactgtagattctttggtggtgacttcaccaaggccatgactagtaagggagatggagttctgattgctggtgtgtggagaaggtccaggaagcccaggcattgtggtctaatggggtaaggtgtacagtggagagacaggatttaaaatatgaccaatcactaggatttggtgatgggcaggaaggtagttctatgaagaaggaatccaggagtatcatgactgagacctgggttcaagggtcttggaggaggcttcagcttgagaaaaatgttctctaggaaactgcgtttatttaccnttctattctccttgtcagaaacacagctatccccagaaatcaaagtctgccagcagcancctaaactatatctatgcaaacacttatgtgaatctcaccgagattgtcaagcaaataacatatgctgttctacctactgtgggaatgtttgcatgagcatcctgtgagtgggagagtgggctnggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccagggatcctacctcttttgctgccactacagatgatcattgagagctcactgtggcccctacagatgccccacttgtcttgcgtcctggtgttcaatttctctccctggctatgcttctctaccctccctctccctctttggcccacgtatccctgccagccctcaggatgcccagccccttgctgttttgctcactgaaccagtactcccagggggaggaactgctcatgtgcagcatctcctgatgctaaggagaacatttctcaccctggagtcagaaggacccattaagcatgagatgggtggcagttagaacccgagataaagagtgggaggcccccaagcactgctttggtctccttagccttggtgcaccgccatcctatgctccccaatctctctgtaaggttcagattactgtctatcattaggataatgagtcccaggaagtccagcaagcccaaggccacaagagagtgagaggatatgatgtgactggaagagggtgtttcctctaggatcactttttcctcacttctctccattacctgagaccagaggcatcctagtgagagtgagtgcctgcaccaaccccaaagctcctcctatccagcacccaccaatatggctactcctctgatgggacccattttgggcctcaggatctgacactccagcaccttccattaactgaatagtccttatctttcccaagccctcttccttaggggctggttcattctcttttctttagatcaagaggaacactaagggatgtggaacaggtggttcatgctgctgttgctaaggagtaattggcacagagtggctatgggtcttccctgtcgtcctactgtgagttggtggaaattaatcagtgtggtacagaatctcccactctgcaatcgcaactcctctgaaatgatcctggggctagatccagggttgggtcacatgtagctaactgggacatgaagccaaatgtgaagaggtttcaggaggataggccatgcccagaggcaggtgtgcagtgttatgctccagtctagtgcttcttgctgggccattcaatgaaagagacatcagagaagaaaacttccttcatcagaccagaggctgtgagccacctctgaggcatcaccgggctctgggtatctcaggcttgtcttcacctttctcaagagcttcccttggacaaggaggtcttaggaaagagatcatgatcaaccatcaacacagacaccatcagatgtactctgtgggctgtaagggcatgatctccaagagaccttatttggtgtttccttggatagcctcccttaccaagcatcctctcaagccacccccaaacatgcctactagacactacaggcatatcttgttttattgagccttgctctattgcacttcacagctatagcgtttcatacaaattgaaggtttgtggcaactctgcatcgagcaagtcatctggcaccatttttctaacagcatgtgcttacttcatgtctctgtgtcacattttggtaattctcaaaatatttcaaacttgctaggcgcagtggctcatgcctgcaatctcagcactcgggaggccaaggcaggtgaatcacctgaggtcaggagttcgagaccagcctgaccaacatggtgaaactccgtctttaataaaaatacaaaattagctgagtgtggtggcgcatgcctgtaatcccagttacttgggagactgaggcaagagaatcgcttgaacctgggaggtgaaggttgcagtgagctgagatcttgccatagcactgcagcctgggcaacaagagcgaaactccatctcaaaaaaaaaatttcaaacttgttttattatcatatctgttgtgatgatctgtcatccataatcttggttattactgttgtaattgttttgggacactatgaactgcgcccctaaaaaatgattaatggataaatgttgtgtgtgtgttctgactgctccaacaactggccatttccccatctctctccctctcctcaggcctctctatttcctgagacataacaatattaaaattaggccaattaataactccacaatggtctctacgtgttcaagtgataggaagggttctatgtctctcactttaaatgaaaagctggaaatgattacagttaggaaggcatgtcaacagcaaagatatgccaaaagctaggcctcttgtgccagttagccaagatatgaatgcaaaggaaaagttgttgagggaaattaaaagttctactctagtgaacacatggatgataagaaagcaaaacaaccttattgctgatatggagaaaattttagtggtctgggcagaagatcaaactagccaccacattcccttaagccaaaaacctaaccagagaaaggctctagctccctccaatattatgaaggctgaaagaggtgagaaagctgcagaagaaaagttggaagttagcagaaattatttcatgaggtttaaagaaagaagccatctccgtaatataaaagtgcaaagtgaagcagcaagtgctaaggtagaagttgcagcaagttacccagaagatcttgcaaagtgatgaagatgtctaaattaaacaatagatcttcagtgtggaaaaataagccttctgtaggaagaagatgccatctaagactttcataactagagagcaaaagtcaatgcctggcttcgaaacttgaaaggataggctgactctcttgttaggggctaatgcagctggtgactttaagttaaaggtaatgatgatcatttaccattctgaaaattccaagtcccttcagaattctgctaaatctactatgcctataaataagacaccatcttgatgatagcacatctatttacagcatggttcactgaatattttgagtctacttttcacacctagacacattttgagtctacttttgacacctagacacctactgctcaaataaaaaatactcattcaaaatactactcccattgacaacgtgcctggtcacccaagagctccaatggagatgtacaaggagattaatattgttttcatgcctgctaacacaatatacattctacagcccatggctcaagaagtgatcttgactttcaagtctcattgtttaagaaatacatcttataaggctataggtgacatagatagtgattcttctgatggatctgggcaaaataaattgaaaaccttctggaaatgattcaccattctagatgccattaagaacattcatgatcgacaggaggaggtgaaaatatcatcactaacaggagtttggaagaaattgattccaactctcatggctgactttgagagtttcaagacttcatagaggagcccactgcagatgtgatagaaatagcaagagaactagagttagaagttgagcctgaaaacatgattgaattgctggaatctcatgataaaacttgaatggatgaagggttacttcttttttttttaagagataggatctcactcagttgcccaggctggagtacagtggcatgatcagagctcactgcagtcttgaactccttggcttgagctatgctcccacctcagcttccctggtagctagaactacaggcatgcactactgcccttggctttttttttttttttttttggaaagacaaggtctagctaagttccccaggctgatctcaagttcctggcctcaagtgatcccctcctacctcggcctcccgaagtgctgagattattataggcataagccatggcacccagtcaaggagttgcttcttatggatgagcaatgaaagtggcttcttgaattagaaacttctcctggtaaggatgctgaaaacatttttgctacttgggaggctggggcaggaggatcacttgaacccaggagtttgaggctgcagtgagctatgatccttgccactgcactctagcctgggtgttaagacaagaccctgtctcttaaaaaaaaaaaatagcaactcttcatccatgaaagttgtatcattagactgttgaaatgacaacaaaggatttaaaatgttacataaacttatgataaagcagtagcgggatttgagaagattgactccaattttcaaggaaattcttccgtggaaagaaattcaaacaacatcacatgctacagagaaatctttcatgaaagaaatagtcaactgatgcagcaaactttattgttgtcttattttaagaaatttccatagccactttagtaaccaccaccctggtcagtcagcagccatcaacattgaggcaagactctctaccagcaaaacaattatgactcactgaagatcagatgatcactagcatttttagcagtaaaatacttttaattatatacactgtttttaacatataatactattgcacacttaatagattatggtgtagtgtaaacataacttttatatgcagcaggaaaccaaaaatatgtgtgattctctttattgtggcagttggatccaaacttgatctctaacgtatatctgcattaagagaggcaaagttagccaggcacagtggctcatgcctgtaattccagcattttgggaggccgaggcaggtggatcacctgaggtcaggagtttgagaccagcctggccaatgtggtgaaacctcatctctactaaaaatataaaaattagccaggtgtggtggcgcacacctgtagtcccagctactcaggaggctgaggcaggagaatcgcttgaacctgggaggcagaggttgcagtgagccgagattgcaccactgcactccagcctgggtgacagagggagactccatctcaaaataaacaaacaaacagaaaaacaatgagaagcaaagttacctgccagtggccacatggagagtaaacttccatgtccaaatccagagcactttgccatgtaaacacactatgggttccaaactgctctatttcctgtcactggtgcaagtgccatgaactatgaattttactagaagcagttgctccaatcactggtgtcctgacctatgttccagagagctctctagacagcctaccctgccccagggaactcagaggctacacctagaatattgcagctggaaagggtgcccatttggttatgactgtgtgctctgtcttatatggaagcatctgtatacctccatattatttacaatagggtggtgaggaatcctggaagactttgaacctcatggagatataggaggaatcaaatgcctattctgccaaaatctggatctccaaaatgttaagtcctagtcatcagagaatcacagatgaggtctggcctgttggtgaccaaatgcaagtcttatgattcccactgcttttgcattatttgttctcttcctatgctccagacatgccccttcaagatggcgaatgcagatgggaggatcctaaaagaatactccccacctctgatgtcatggtattggccagctcctgcatcatttccatactttggccacagctgatgctcatagtgagtccataactgatgctgtcatcagcaatatgtgccccacccaacctctagttcatcctaacaaacctaggatgcctaaatcatgcagtacagaaggttatctgaaatgcaagggttgggtttaggtgctaagtgcaatatctatcaccaagaaaagtccattagccaaaaatatagttgcaataactatgacatgaagcattcaaagatagtcttctatccagaggaagtctcttataactctcccattaaatatacattctttagaattatacccatcagttaatgtgtccagtgtcttaacttgggaagagttcacttcttgaaaatttttagtgacagatggtaaaatgtagaagtaagtatctgagtgaaagggcactaaacttcagatttctgaggctattctggatcattgtggctagtacatggtgacaccttgccatgttgattcaagtattcta

SEQ ID NO: 10804 - DNA, 60217 bp, Homo sapiens
  misc_feature (1)...(60217): n = A,T,C or G, or insertion/deletion polymorphism (see Tables 1-2)
gactattcgagctctactaaaccactctaggacatgccttctttgggtcatcaaaaatcaactctcctcgcctaggttttattcttgccaacttagcattcccacggcaattcactaaaaacgccttaaaaaatcattagctctcatttattcaacttgaacatcagcatggcctgaagctcgggaagaaacagactggcatagtgacgctgccagcaccaagtaaagttttacctcccagcgctccaggttcccagcaagacttccagccagggctgccttccactccatttcagcctggcaccctgactctcgctctaccagctgttggcacgccttgtgttaaccgagaatttgtgagaaaagcagaaccttcccactgcgtgttagttttgcttggcaacactcaacaatctcaaattggaaggccccaaggaaaattttttgttgttgttcttctgcccccaggatgattttttcttcttcttcctgaacctgtttggatttttttccacttaaaaaatctagcagcccccacctaactgatggatacttgtaggtaaatgactctatctgagcaatgatgcgctgactgggcctataaattatgacccattgtggttagttcaaataaaaggaggttccgataaaggaaaactgacactcggaattttctctctcaaaaaggatgatgtctagggatgcaaaattcaggaatataaagagagaccttgcaaatgtatcaggctcttctaaaatacaagggattggtataaaattgtcctggtgaaatcaaggggaagcacacaggactaaggaaagagaggcaagaaatatatttcttctcctttgcagggaaaacactgcattgggaagaagcttgctctttccaaatacattccattaaattgacaaccacagccaccactgccaccacaacaaaaatcaggccaacctagatcaaattactaggaataggtctaatgttacttttatgaccatgaggtcctggccctcatcagaacctctgggttacccgtcctatcacttggtaatgaatttcatatatgtatgtgctgttaaagcaaaaaaaaaaaaaaaagtaaactcataaataattcatcacactgtctcctgccaactgatcatatattgttcatgtttcaccggccatattaaataaaaatttaaaagtgtttccgtttttcatttaaaaacctagtctataattggaggtgaccacacgaagtgtcttgaaggtagcaggcattaaaaaaatcattacttaaattgcacagttaaaaaatattcattagaaatggctaaattaaagaaaaaaatgttagggaatcttagggaaatgtttctcctaaatgttgtccctaaaactgcttcactctaaaaatctgttttgagcgacctgataaaagggaaagagagagtttcagctcaaactcaggaaagaaaggctgtaccagtttcttcagaatggaacattaaaacaggccactactgaaacagttcttgtgcctttgtggctaattattacataattgatcttaaaaaaatttttttaagtttaggaaaaaaaattagaagcctagtgaaagtaccaaaaacactgtaacttttttgtttaaaaatttatatcatgaatcgaaaatcagaggagatggccgttttggcctggtctccgtcctttccttctctattttgattgagccagtcccttgttaagccatcagaaaacagagcacacttagagctcttaaactgctttagacacaaagaaaaaatttaaaaggaaaaaaaaagcaataatcgtgtgacatctcagagatgatagcatatactgttgttttgcttgatgacgataacacaattctttttgaactaagtatctctctagactacaactgggtcaaaattatagatattttttgtggccctggatgaattttctatttgccaaaactcaaaggattcaaaaccaggttgatgtctagttaaagatgatgctccaactgcttgagatgctagttcatttcaacagacattaagattgaaggagtgtcatagattgcttaggcaattagaaatttaaaaccgtttcaaagaaaagaaaaaacaacaacaacaaaaaagttatgccataggaagcatgaagcctcatttactaaagtggagaaatgtattttattttattgtccttatggcgttgattgccagttctgacacatattacaaatttcacattgtttttctgaatgctgaggtcagacctaccataagcttgtcccgttgtattaccaaatggctaattccctcccaggtattggagaaaaaagtcagaagggcagcatcctaagagaatgggtgcccagtatgacaaggagctgctaagataaaatgaactttctaactaaaaacagaaaagaaactataaaattgattttaaaatctgcaggacatttttttaaaataaaggataaattaactatgaatatattgagtggttatgaaactaatatatcttagcataacagagtagagacagctttaacttttctatgatactcatatagttatattttatgatgctctaataggtatagggtacataatgaagaagaagctgtttgtggattcattgtattttattttattttattttttactgctttgagtatgaagagtctgcccaaatatactacttataaatcataccaaaagtgcatcagtgaaaaccacagttccatttcttaggggaaaaaaaaaatcaagaatcaagttttagaatccaacgatcacattttccttaattacaaacgaagacatcatgtattatttttctgtatccacaagagatgagagaaatgtaatttttatcgcatgttaagttttcactgaatcacagtattattaagctttaaatcagaggattgtttccttcagctaagtctaacaatactagaaagtaaaagggggggacaacccccacctcatctggggctgcaatatttgctgaaaaaaatctacttcaaaacattaatcaaatttttcgcccactgggcaaccatatggtacagcagcatgtgaatctcacaaacttgctgatctcctgtaactgggtgcaattaattacgctggctgcatccatctcttggattttcgccttgtgaaaaaagtatttattgcaacagcttttacaaaacaagggaatgaaaatcacaattgattaatgagctgaatggaaatatttccgttagcagatttttttaaatgaataaggattaataccatggatgggaatgaacacacgtcgatctcgccttgtactttttggacccccaaaaaggtggcaaaagagtgggcagagacggtgctgtgagttctaacatgcataattcactagcaggctttaggtcgcaagtaataaagccttaaaactggtgaagtaataaagaggctggctttacaagatactatcctgggagacagaaagcttgttctttgatgtgaaaacacagatattaaatactcagtgggtgaggaacattacaggcctgacaaagaagagaaagggaagggctcttgaagtaagcaacctactttgtcctcagctatttaggtgcaaaggttgctgcacatatgggccgattactgttttaagatccctccataaaaccaagcatccgagagtccgtcagaatggtaccactgtccttacctactggctaaaggcacaaacaatgcataattgcaaaatcttcccccagcaatgttcagccatcatgcacttgactttgcttaacagtcagacctcgttctggtgctgagccatcctacggggcttcatggagcttgtttcttgatacacatgagggtcgtaatccctcccttctaacttaatttttttttttatttttatttttcagagacagggtctcactctgttacccagctggagtacagtggctcactataatgttgaacttctgggctcaagtgatcctcctgcctcagcctcccaagtagtcctccaaaggactacaggtgggtgccacccagcccggttaattttgttttctctttttttagtagagacagggtctcactgtgttgcccagggtagtctcgaactcctggcctcaagtgatcctcccacctcgcctcccaaagttctgggattatagatgtgagccaccttgcctggcctcaatccttcccttctgagggagtgacagatccaaggctgacagtctataaacaaagcagaagcagatgcactttgccccttttcagaagtgccctctgggtttaagtccaccagctagccaagcattaatgacatcatcattacatgcatgcctatttcagaaagatcagttccattttccctaaatagacagcagaggagaccgcttccaacattttgctagttgttaaatatgtatcttgagaaaacgaaactaatactaaacataatggaagaaatacgtaagtttgaaagatcaaatatcgtatgactcttgaaacagataaaggaaaaagctgttaggaccaagctttgtaagtcaactcttaagccaacccttttctttactgcatctattgcatttaaacttctaccaggaaattctgcaaaggacttggttaaagagaatttactattattttattaatgcctgcagagtgtgtgtggctagtatgatgatttctctgctcaagtttgttgattgattttgtagaaatgtccacaggagataaaatctgcaaactcctcaaagatgagactgtgtccaagaaaagagtaatgatactttataaaacaagaagtaagtgacatttgaaacgatggttcatctcaaacaacacatttcctctgagctccatgtttatgttaacatgtaagtttgggaatgctgatgtaatagacaaagataactcttgccacttcaaagtagcaggcatgcctaggtgggcaagaggttcagaaagccagcacttaaggtgttgaaggggtaatttttaaaaatcttaagaaaatcattccatttgagaatcggagccaccttacaatcaaagaagccactgttttgaagaaaccactatcctgcaaaaagtagacggaagttaccaacaaaaagtacttggctcccgaagaagaggaaaatcagatgggaacgggttgtccaaccccttaaaccagtgaccctacaaagtacaccaccacccaccaccacctctcagatgatctctaaacccctcctacacgcaatggttgttggcttaaaagtttaaagagctaacaaaatgttttaacgagatacaaatctcagagatcattaatcaatatgttcaatgttatttgtgataattcatcatgacgtgatattaatgggttactgtacccttcagaggtgagattaatgcaaatgagctgccacaattaactttactgctcccacctcacaggaatggacagatgattataaatgacaactatatgtcaattacaatatccaataaagtgaagcttagagaacaatccatctccttttattgctcttccttgacgtagctgaatttagctcaacccactgttgtcactatgtaaccattgtttgggggagggaaaagagatttttcttctttttttttttcttttttaatttttcgatgtcttaagaagtgcttcaaaaacgtccatgtaaatacgttttctaaaggaggagagccacaggaaaccaggaataaatgccacattcatcctatgtgagttaaagaaaactgtatccgttttcaaattgtagcagtaaggccagcaaggaaacaacctacccagctgtgtataatatatttactcaattaaaaaaggaagacattagcacagcatcctgaaaagccttgagtttcactaaacaaaagttatttgaaaatgactccatcgaagtaaataggtcacagagtggaaagcaggtatgaggccgagggcgggatgaaaggtttgatgtcagtctgtacacctgcacttggaggtgtggagtggggagcaggtcagtaaatactacagtgctggccctcacagcagagaatttctgtgtctgcatcgttcctccttgcatggatggagtgatttttgacagcagtctctctggtgaaggtaggcacgttgtcatgttgcctcctcaacccagattctcctgccgggctggtgaacccagaagctgtaagaattagctagtatctcacagctaccccttcctgccccannnnnnnnnnnnnnnnnnnntatgtccacgccgccctcttccccagcagacactggctcatcgctgactgccataggtcagccaggccctggtctcagtcaggaccaactctgctgtagaattcaccctccagagcttcccgtgggatcaagctgaagctgatcttcagctaagccacatccttcctggacattttccctgtccttttttttttttttttttttttgagatggagtgttgctcttgtcactcaggctggagtgcaacggcacgatctcggctcactacaacctccacctcccaggttcaagcgattctcctggctcagcctcctgagtaactgggactacaggcgaacaccaccactcccggctaattttttgtatttttagtagacatggggtctcacatcatattggccagcctggcctcaatcgcctgacctcgtaatctgcgcacctaggcctcccaaagtgctgagattacaggcgtgagccactgcgcccggccacattttccctgttctaagccactcttctcatttcctttctgaaagcatcctgacccccatcaaatcagtggaacaagaagactaccttgacctgtgcttccaggtaacagaacgcaaggcaggtatcaatgagatggaaacaggaatgctcttaatgcagtgcaatttacaaaagaactgttctttgctgaccactagtaagagaccatccaacaggctcctttctgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaattggacctcattttwccattagggaacggggcctctcagactcygtggagaagcagagaattatctccagccttgactgcccaggctgcagagaaccgcatcatccggggacatgactgattcagggataggtgtctgcctaaaactaggccaatcctggttctccctgtggcttttgggccaagggtagtggggaaaacagcttcttgtcactgggggaacaagccaagatgggacagtgctcgyctgccagtggcagccccattyggagagaattttccctttgaagaatataacccataaaagatcatcaaaactaagggawtaaataaagaggggacctcgatgacatatttaagctctgaataaagctagactctaagcaggggttggcaaactataaccgctgggccaaacacggctgtgttcttatacagcacacaggctaaaaatgcttcacatttttaaatggttgggggcgggggggaaagaataatattttgtgacacatgaaaatgtatatgaaattcaaattccagtatccataaataaagtttctcgcagccatgcctgctcctttacatrtcgtttatgcctgttttygcactatgagggcagagttgagtagttggcaacaaacactacaaggccccaaaatatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccagtctgctgggatcctgatatagtttggatatttgtcccygcycaaatctcatgttgaaacatgtccgtaatgggaggtatttgaatcactggggcrgagccctcatggcttggcgctgtcttcaccatagtgagtgagatctctggagatctggtcattttaacccttttcccatttgccccaagaatacttactggtgtgcagtgtttaccctgagatcgctttgccatgaaatatctcgcttttattatttttttcacatcactctagcatatcgactttggaaacgaaggatatcattctatttatagccttctgtttttagtagtggtatttccatttacaaaatataatagttctccatcactgaaaatgtcaaatccgagaaaatgtagcattcctgcatgtgatgttaacatcattctcgaacagttgttggctgaagattcatttgatgaatccgatttttccaaaatacacaattctgatgattcagatgattctgatgttagttctgttcagaaataattccaagaactgtttttatattttattatcactttgaaaatcggtcacatttgcttcagcttcaaagagcatgtttatgtaaaattaaatgagcgctggcagtgagctgcgctttttttttcctaaacaggaaaagggttaaaagtggggcacctcccacccccaccccacgctctgtcacttcccactgtcaccatgtcacctgctgctctctctttgccttctgccatgattgtaagtttcctgaggcctccccagaagcagaagccgctatgcttcctgtaccacttacaaaactgtgagccaattaaacctcttttcttataaattacccagtctcaagcatttctttacagcagtgcaagaacagcctaatacatatcctacaggtaacgtctcaatatccagatcaagtgactggttgtttctcttacctgtttcgcagaagttattgcattctttgttgaatatcacaaactgttaatatgttaatcttaaaacatgtgaaatatatataatatctatcattacaactacaattccaaatatttatatataacgtcagccatgccaatggacatgcaattctaggcccagcaatggacgataaagtaggttaaaagtgggggagaaaaactggttttaaaaaactgtacctgaagaacatatttaatttaaagggaaatcccacaacagctaaattgttcccccagttgggtagagcctgccatgattagctgtaactgcctggaacactctagactcagctgacgaaactccagttgcctggtgagaacagagtgattttgatgacttttgcagaggatcagaaagaggggaaacggattcatttgattcatttgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaagattaaagggtatctcacttttattttaacaatgtgaagacaactgttgttccttactattaccaatctactacactggattctaatagctctattacattttccatacattctcctggcatggggcataaatgggtgagacagctctggataaatcactgccagcagcagaggcattttctttagggaatgaaggcttccatatagcatttaactaactctctttttggaaacaccccatcacaaatgagtctttcaaactgaagaaattgaaattgatttcttagggtaataattaacctcagaaaataatgatgaaaagttgcttattaattattttttataatatactttgggaatatttcttttttccatgaaagatagagacaaaagtagacacattttacaatcatataaaatgtgattagactcatattttataggagaatgaaactcatttaatttgcaaaatacttaatatgagagggaggtgtccccctacacacacacactcttttcaagactcttaaatagccctttttaaaacaacacaatctctctgttctgttctttatttcttcacacataactgccttggagcttttaatatattattgctatttcaatcccccatggtttttctacttattcaaaaagaaggtatttttcatctgaatagccattgacagcgaactctggtgacatcctcagtcttccttgacaatgggaggaggagttgtcaccaagaaacttgttactatcccaagtaacgagctagcatccctcagataatacaatagagatggactagtgtttttcaaacaatttaaaacacacacacttatgtacacagaaaaacacatgtatacacgtacacgcacacacaaacacacacactttaaaacaccctctttttctttagtcacctgaagagtcgtaaagcataactgcaaactgataaaggtataaattaaatcatataatagatgttgttgcaaatcgtacatgtctgtcagatcaccgagatagaagtcaaaacatgaaaagaccaggaaatacccacaaaagaagatgtaattgatgagactattcaagatcttttattttttccttcttttgctagtggaaaatttttattctgcacttttctggcggagggtggtattttgttttctgtaagatacaaacaaaagacagttgtgtaaaattaagttatgagaacaacatagaactgtttcttgaagcattccaaagataagtttttgctaattaattaacaaattcaagctggttaaataaaaccttcttccaacacctcctatttaattgcagtttggcaccaacaaatatatatcaaaattatagtatttcccctgacaggaagctccttccttccacacactattatggctctctgcagagtaagccagaattgctgacaaccttgaacactgctacaacaatattactatacttggcagagaagtacccttgcggcaagagaaaagctgtaattttgactgtcacttcacattacactagatattatttcactgtatacacatacacacactcacaaactcttaatagactacagttttcgcactgcctgcctttccaatataaatggcaatataataccagcaaaccgccaatgagatcctggagagaaacaaatgtttggcattatggaaacatcatcagaggatgcattttaagggatatttcattgctttgtcccccactcacaccgttcacaccccatcatcaacttcataagatcatcaccttggttatcaaaaagaaattcactttttttaaccccatggtgggccaagtcagcattaacaaattccatgtttaaaaatttccatggtgttagcaaagggttgtgctatgactcgtaatattttggacattcttcaaatctgatgcctgttatgtaaaatttccagatttcacaaatgtatcctttttcctgcatttatctcgctttccttcacacccggggggagtttgttaaactgcagtgaccactggcagagtcccaagccaagccaaaccgtgcaaacatgaaacggccccacaaatcatgcaaaccctacacgctgtccctgccagagagcagcgcctgtctttgcagagaactaaatgcaacatatgcttccttcttaccaagctcacactgaagcagattgggccaggttccccactgtgccctcccccaccccctgcccagctttgatttacaagatgctatgttaatattccctctatttgtcccaggcaaggaattctgtgatgtcggtatgagctccaaattgagaactccctggaatccggagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagcttctctctctacttaatctctgccatccccctttttttcctcccctttcaaattgctacttcaaacgatttaaataagatttaaacttgttttactgaatcaaggaaaagcaacagcaaactctttgccctctgttaagagaatgtatccaaaacttcaccgggtctgctgaccacaccgaatttaacaaggttcgcaaatgaactagagtaagtttcccacagtgacacattaataataagttccttatcccatccatcccaagccatgaatatgtaatgttataaaatgagtccttttcacacaacggaatctcagacgtgaataaataaaaactatccatcacaagcctgtgaaaaattaatgagagttcggagatgcaaagaaaaatggggacaaggagagatggcccagttcataaaagcctccctaaaactttcagacattaaatatcctagcccccgtccctcaccaaattgccaggtgtgggtggaaagcaacagattttatttttaatgggctaaaattttacartcttaaagcacaattcatgcaagcaactgagagatcacagctacaaacactggactttctattttctccatgcgatcccaatttcagctgcagagccagagtttatttctttaattattcataattcataaccaacctacttccagaaggatttgaggttgctcacagcagttatgagaaaagggagaagagtggggctcgcgcagggctcaaacatcaggagactggaaaaactctgctttgtgcattgttccttgacatcgctgtggacacacagtgcctgattaaattgtatgtgtcgcttgggttataattattatcattgtcaaaaccacttgctggatgctcactctctgcccagcattacactagtgctatgccctgcataaactctgattctcaccctctatgaccccatttgacaaacagggaaactgaggctgggaggagctaactaacctaccccaagtctaagagctggtgagagtaagagccaaaggaaggaggttagccagctccaaatcacctgtgcttcccacctggggccactcactaccactcatgagttaaggtgtatgaaaacggctttggtaacctccttcttgccatcatgaaactgcagcacgctaatactgtcagtctgtctcagaaacccctgccagccagaaggcttaactttgagatgaatgcaaagcagaatgaagcccaggaactttgggggtctgggctaaggctgatgctgggcagcagattagaggcagagcagagcccagaagtccagcctcccctcccagtgcactcctcgacaagaggctgcacttcctcgtcggaaggactccaggtcccactttgggaccagacatgctgcaaaaacaaagaaattcacccaaactggtttgccctttactggattttttctgagactgaaagtgttgccttaagggacaaataccaaaaggaagatttaaaaatggaccaatggggacaatctgcttaatctggcccaacctcctccctcctcccttctccaccatccattccatgtgggcagaacacgtgactcatgggattactgggagcctgccatgctgttctgttttcaactcactacttttgtctgcgctattctttcattcaggataccgccccaacctctccacctggctaaatcactcatcctttgagatgcagaagccaaagagatcctcagcacatacctccagaaagccagttactgcaggggatgcgtacggaccagccaggtaatgtcaatttggaaagcgggccaggtataaattaataggggctggttggtgtgagctgacccggtgggcacaagccccatcatccaactggggcggccaccgtacagggtgagtcaagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatccttaaagcataaaggcaagagccaagtctcagtaaactctgcatgggccacagctcggaaaagaaaaaaacctgttatatcgtgggagctcagtgcttgctgaactgaactgattcacatcatgacttgggattcatgaaccagaagcacaggaaattaataaaaactgaaaacgagccaaagagaagggaaaggctctcttaccactgttgagaatgttatgtttaatccctgcaagcagtagagactcagtgtacttccatgaagtgctgcttgggcattcatgaggcattaagggagaaagaatttttaaaatctttgtcttctcaaaagggaataccacgatggggccatgtctagagcaaggtgtctaaggtgattctagggccctcgcccaagaaacgaaagcagcattgaacatgtccaggaaggatgtgaagcctgaagccaatgcagaagacaaagctagataacccctgtctctaagacatagggacttagaactcttaccctgatgagcaacattgaacattggatgtgttcaccagaatggaaggagacacactcctgccgaaatcatgaagggcaaactgacccagaaaagggacaggtcaaggaaggtattacctctgcatagttctaggtgtcctgcttaactcattcaggaatttcrggccagagggatatycaacaggaattctaamctgaagagtttagaaaccagtaggagaatcaggatgaattcagaaattactataatatgcattttcaagtgataaatcccatcaaaaacagaaaaagtgcttgaagaactggaaggaacagtgatcattcttgtcagatggaatcttaaaatccagtgggtttcaaaggatgagcaggagctggacatgaagggattggaggatggggactggaaatggggagttcattgcaatcagaaggaagagcaagaaaggaacaaaaagcaagcagtgtttggggagaccaggatgtgattccagtttggccaaaatatagggtatactgggagaatctattgaggttttgggagtgtatttgtttgtagtttgaaaacacctaagcaattttgaagagaagcagactctttaagtcagatgctgggttctccagtccaaatatgccaatataattgtgtctggtcaatgtctatcctgtccatccctcctgagtgccagatctaaatccaggtgccaatggatgacttccacttgggtgccccacaggcgtcatgaattcagtatgactgaaaaggactcctcctatcttcagcgatggttccactacacaatacactgtccaagccagaagtcccaaactagccttctgtccttccttctccattcaccacgcctgtcatccccttcagagctgttggccaaatcttgttgattttaccaagtatctatcaaaatgtttcctcttcctccctgtactcactgcaatcacttttgctcaagggctcatcatttcgtgcctgggtgactagagttgtttcccagcaggtctccccaccctcctttctcacatggctgccagaacggtcttctgaaaggcaaatctgaccattcgacaactctgctctaaattcctcctatggatccccatggcttggatttaataaatgtttattgagtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttggggaaacttagaaagttcaaccacctggggataaagtttggamaactaggctagggccaattcagggtacaggtggaggctaggaagtttggcataggatatcattaaaggtcttctaaggatgaaggcaattggagctacactataggaaggcacagcaggcggagaacagacttgagaaggatttgggaggtgaagaaacagctaaaagactctatctctgacaaagatataatgcccagaattagaagagtggaaatgaaggaatgatgaatgaaagagattatcaagaagaaacaaacaaacaaataaacaaacaaaaatccctgtaatcagtaaccatctattattatgtcccagattttggaaatgagaccctaatgacaagcactcctaaaccttcaacatagctgctgttaaggatgttgtcttgtgggggtgaaaggcagaccaaaatgatactaccaccctactccttaccgatgagtcctttctgattttaagcaaatggcatacagtgtggtgaattaaaaacagcattatcctgattttattactagtatcattactattagcattattgctactgctgttataggtaaaaatgggaacgttgtgaacatttcccattgcctatccaaggtgcttggtactttacatgatatctcacttaatcatcagaaagtttggagttattctataggtaatgagggagatgctattattacctgctgtggtggaataaagatggctgcaaattctttgtcacttctaccagaagaaagtgaggtgtatgtctgctccccttgaatctgagtgggttttgtaactgcttagtccacagcagtcatgctgtgccaacccctaagccaggccataagaaactggcagcttcctgttactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcatcctccagcatagcaccactgactgaccccagtcaacaccacaaggggcagaagagtcactccactgagcccyaacttasagaaatcacaagataaaacaaaatggttgttgttttaagcctctaagttttggggtaatgtattatgcggctatacataaattggaacatccacgttttacagatgagctacttgttactccaaaagtttggctgacttatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgttaggtagagaaggctggacgatgctacaactgcttctccgccaggcctcccaacgccctcgctgggcagagtcccatgtgactgttttcactgctagaaaaattaacttgcataatgaccaggaagtaaagataaactcaaggatgagagaaaacctcccacctcagaggctccacctcactggggtgaacaagcactgaccttctatcatcctataaggaaaacaagaagaagagatgtttacttgaattactacataggctccctgcctacatccacatcttgaaaattctgagctgtgaagctcttgtggttggctcctgggaacttgagattcccagtgatattccaatgctgaaacagcccagcaaggtgatgcaggtaagcacgcttgtaggatgtaacaatgtgaaacctcagcacattgtggttatgtttcaaagcacgaggtgacggaagcaagagcgagtttacatgggcttgtgatttcctttgacaagatacacgcactcattccttcaacctaagcaaaatttccaggactacaacagatttgaaactcaggtggacgaaaaaaaccatctgtgaatgggataacatacgaaatcatcaaaggtaattgttttaaaaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatgaggcctttcaatgcaactatttgacctgaacgcaaacaggaaagggttgacacattttctctgtgaagggccagatagttaagtaccttcatcttcgggccacgtatcgtctctggcacacagccttctttggattttttgttcatttttgttttttttaacgggtcataaataaaaggctactggctggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatayagaggacttcgttactcatggcasagcaaacagcatgagctttatttctgcactgattcccattgccctggcccctagtcmcacagggaggatgtggaacagcccggtagatgccgtgctcatrgtacgtttcagtcatggctgargagccccaagcttasaaaccccaacctttatcaagcaaatctgccaaaccgttgtcctggaaggaggcactgtctttattatactggaaagaaagccatcctgtcctctgctcctgagggagacactatctgtaccttgcaagtttctttgctagacaacgttccttggaaagatggcctgaaaccaaagctgccagcacttctgttcccaagacatgtgaaaacacaagagacccgaggatcactgtgtccaaccaatgacagctaggagaaaatgcaaaaactagcattaccttaatcacaggggtctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtacctttagttaaaaacagaaaccaatttgtaaatgtgaattaaatgcatactccacaaaaaaatacctggtgaaagtaaaaaaaaaaaaaaaaaaaaaaaaacttccttatgtatagatatgtttcctgacagatgtaaatgaaaactaatacggtgacatttttcaaattagccactggaaaactgtgtgtgtgtgttttcaaacagcccgagcaattttcagttatgtcggcctcggaaagtatttatgaaaaggataataaataattaattctactggccagaagctgcaactcctttctgcttcgacaatatacattgaaatgctgtttaaattagaggagcaaattgattcaaaaggcttccattagtgagctggcaaacaggtttgaagttggctaataaattttagataaagatagagcttttgatgaggatggcaatgccggactgctgatctccgagtcaccagtttgttaaatcggtggctgaagtcttgatttcgctccctgtgtcataactcactgtgttaaacaatatgtcacagggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctacctatgctatgtcttgcagcataaagtcacgtctgacatatctattaagaaagattcttaatcaaaatcaagaaactacgcatgaagctcttaattccacttggatatacatactttagctggcttcaagctgctcctctgggttgtggaatattacacagctctgtaaaggaatgatttaaagctgtacatactagcctgaaagggcacacactgtacactacctggggatggtggagtatgtgtccacttatttcagaaaatgagaacaaaatcttatatatgtgtacatctatattaacatgaaggaggatgtacaagaagtacaaaatactaatcatggttgcctcagagggatagaattagatgaaggaatagaaagggtttttttaatgcctcctttagacagctctataattttaaaaaattattcaaataatgtataataatgttcttttataattaaaaaaatctaaaaccaagaaataaacaacatgaaggcttatgtgacttgcagaaaattataaaatggggaagtcatttatttgcttagcttatttctacctggccagtttggggaagcctgtggagaactgatcaatctgtctttctgtccatccactcttccacgtatttaaccaagaaaccagacctaggaaatggtgggtgaagagtaaacagctttagaatccaccaggcctggagagaaattctgcctctacccacttgcaacctatgcagctttggaccatgctctcgatgtcttccaagaataaaataattgtaagagctacagcaaatgcaggtagtgactctacaatttcatccacaaaggttagctcttttcctgtgcacaccaggatctcagtatggctaccctgagcagaataatctacacttggccaagatggcaacccaggatgataaaagcaaaacacattgcagagatctgattattaaggaattcaaatttacactttctcaaatttgtactacttaccaatggggaaaaatagaatgctactttttttttaaggaatactatattttcccttttatttgtagccacttttcaaatggagcctttgtgaagtacttccagccttggtcccaccatgggaaaggtggaattcatagaggaaaatcgtggagcaagccagacacggcggctcacgcctgtaatcctagcactttgggatgacaaggcaggcagatcgcttgagtcaaggggttcgagatgagcctgggcaacatggcaaaaccctgtctctactaaaagtacaaaaacttagccaggcgtgggggcacgcacctatagtcccagctactcaggaggctgaggtgggaggatcacttgagcctggaaagtcaaggctgcagtgacttgagattgcaccatggcactcctgggaggctgaagaaggagaatcacttgaacccggcaggcagagatgagcctgggcaatgagagtgagaccctgcctcacaatcaatcaatcaatcaatcaatcaatcaggtggaacagatactatccctcactacaagtggacaagtggatctgaagcagtgtagggagcaggatgaggacctcacaggcaggtctcttaaaagacagtgtcagatgtcctgcagctcatgtctcaggcttggtttccatgcctggatttcgctgccaaggactgagccttcctcaggggctcattcccctcgagtcctgggctgaccccagcaagagggaaggacagatacaatgcattccaatcagatggccttcctttaagaacactcatgaaagctactgacactttacactgactttcacattttaatagactacaaaataaaatatccaaattgtgcaaatgcagaaaatgaagcgaaaagtcagagtgattcatttttatttcttaattataaaacaagaaaacatgcaattaatatccgtgtgaccacattaagcactccacacataaatgaagcagaaagaacaactaaaaagtatttctcccctttcttagatacaaaaattacgtgtgtgtgggtacatgtgtgtatgtgtctatgtgtattagttcattttcacactgttgaaaaagacatacccaagacatggaagaaaaagagatttaattggacttacagttccacatggctgaggaggcctcagaatcatggcaggaggcaaaggcacttcttacatgctggtggcaagagaaaatgaggaagaagcaaaagcaaaaccctctgataaacccatcagatcttgtgagacttattcactatcatgagaatagcatgggaaagactggggcccatgattcagttacctcaccttgggtccctcccacaacacatgggaattctgggagatgcaattcaagttgagatttggatggggacacagccaaaccatatcactatgagagagagggggagagagggagacagagagagagagagagagagaatagaagaatagaacttgcatttatcaagcacttattacataggaggcgatgttggaagcgatgagtttagctaagttaacttggttcattccatacaacccaaggtagtggatactcattatttcttccatttgatgaggaatctgaggttgagaaaaataaaaaagctcacctacatccctacaggtagtcagcacagagccaagactagactcaagcaggctagttccagagagtcttatggtcaccctatgctatcctgccttcagagggaagggacaaataagaagaacaaaggcagacgtggagatgatagtaggggttgccaagctttctggaaaggagcagagagtattttaggctttatgggccatayagtctccatcccaactactcaactttgctggcatagtgcaaaagtagccacagatagcttataaatgaaggtgtgtagggctgtgttccaataaaactacttcagatctctctggaayttcaataaaagtttttaaaatttagttatgaacactgaaatttgaatttcatacaatttttacatgtaataaaacattattctattggttttttcccccaaacaattacaaatgtaaaaaccattcttagctctcgggctgtacaaaaacatgacaggccacatctgaccttcaaaccacagtgtgtagacccttcatatcagagacagtttgatgcaggggaaattgtttcacctttagtgtgagacaggtctggtgttcagcccatgctctgcccctgtgaaagagctctgcaaccctgggcaagttcttcaacagctctacacctcaattcccacatctgtaaaatagggattaacacccacttcatcaatgtgttttgaggattaaatgaaactggatgtatattaggccaagcattgtactggatacaggatagacaatttattaaggagtctatttacttgacaaataacttactgagtcctgttctgtgctagaaactattttaggatgaagacacagctgtgaaaaaaaaaagctgatacaactttgtgccctcatggagctgacaaaaaaagatattcgtgttttttgttgtttttttttttttgacatggagtttcgctcttgttgcccaggctggagtgcaacagcacaatctcagctgactgcaacctccgcctcccagactcaagcaattctcctgcctcagcctcccaagtagcttgggattacaggcatgcaccaccacgcccggctaattttgtatttttagtagagacggggtttctccatgttggtcaggctggtctcgaactcctgacctcatgatccacctgcctcagcctcccaaagtgctgggattacaggcgtgtgccaccacgcctgcccgttccaagatatttctaaatatgaaagcaacccaacttttcatcatgattcttagtccatccaggctgctataacaacatacattcaacagaaattaatttcttggctgggtgaggtggcttatgcctgtaattccagcattttgggaggccaaggtgggcctcagggtcaggagttcaagaccagcctggcctacatgatgaaaccccgtttctaccaaaaatacaaaaattagctaggcatggtgccatgcacctgtaatcccagcaacttgggaggctgaagaaggagaatcacttgaacccggcaggcagaggttggagtgagctgagatcgtgccactgcactccaacctggacgacggagtgagatttctgtctgaaaaaaaaaaaaaaaagaaagaaagaaagaaagggcaagggcaagggaggggaggggaggaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagaaaggaaaggagaaaaagaaaaagaaaggaaagaaacaaagatactgactgatttcttacagttctagaggctgggaagtccaagatcatggcaccagcagatctggcgtctaatgagggctccatctctacttcctgtatgtgctttcttgctgtgtcctcacatggcagaaggcagcaaacaagttcccatgcgcccgttttgtgaatgtaggggttatcaacaaacattgcagccataccacatgtatagaccctgcccgttgaagaatgagtcaagaaattgggtgggtgttctgtcatcgatcaactcttgcttatcacccctctgcagtgctgcatggaggtctctcatatacgtgatggaagtgatttgtgctttcagctgagagtagcactgtatccattccaaagtttcagttagcctcagtccctgatgatctgcaggaatttctccttctctcttaaaaaagaaggaacatgatatgccacttgcaagattaggatattytgtttaaaaagaggggataatttaagcagggctggcggtgggrgcggggagacaatggaaaaggctgacatctcctgagcatggctcaagaaggcataattcttccgcatgtataagaataaaacctcttaactcatctcccaacacactgatgtggtggcccaaagtaggctttcaggacagtcaccaggagaaatgttatcttgtgggctataactcaccttctcccaagtgggtccctggggccctctgtggtgatgagcaaattcatgccaaatgtcacttcgtaatgaccaagactcaagaagtgatcaccgttacaatattcagatacacttagggcaggtggccagaaacaaaccatccagagataaatgaacattttgcgctccacagcaaaaaaaaaaaaaaaaaaaaaaaaaaaagatttcacagccaaacacatatttctttgttgcattaagggaaaagtcgtgagatggcaagcaggctgtatttttaaaggatgaaatacagcaaggctgcttccacactggccagcctgagaagcacactggtgaatccatcccaaggcagagacttctagagcctgagagttggcttcattggaggcaggtgtactggggaaaactgatatcctttctacttactccaggtaagtggcagataaatctctgggaagttctggctcaggcattcttctcatcagtaattacaaacctaaaaattacgatctacatttgagtggaacaaaatggactggtggcacttctttcttttctttctctctctctctctctgttgacagccccatcacaaagtctctgcaaagctatgataacctcacggtaagtaacaaatcaactgcagccagcaagggttgattaagaggcgtttcatcactgcatggtgttaatgagcatttgctgttcttacctgtcctgcacttatatccccttctccccattcacctttgggcaacccctcttctctgtgcacttcaggggagccggaccccacatcctgaattaaggggtgagcacatggccctggatggaccaatcggagatggcctcatgactcaggtctgtccaatatgcatgaagccctgggcactgattggaactttgaggaaagagaatcactgttgtcctggtcttgctgagaggacacagtgtatttatttctttgagaggaagtctcgctctgaagtgcagaggtgcaatcttggctcactgcaacctccatctcctgggttcaagtgattctcctgcctcagcctctcgagtagctgagattacaggcacgcaccatgtttcccccagcttctggcttgctacactatggaatggaagacggatgcccaagaagaccaatgtaaggaaagcagagccaagggatggagacagagcatgccctgaaaaaataaggcaagcccatgagagttgagcagggctaaaaactgttttgtctctccttgttgtttgatagtgtttcaaagccctcagggaatgctgcaaatagcttctcaggctatgagaatttcagctcctacttttatgatcaacagagtaagggcatctaagaatgactttttctcaggctgtcacctccccacagcccagatgggcctatatttaaagatccgagtcttagcagtccaggggctatctgtcatcacagaccatctgtgggaccttaggtagggcaggtctgtaagtctaaatatcccctcctcctgagttcctgtcctgtcccctttgcctgaccttctccaactgttctcattagattatacttcatggaaaggggcatatatgccttatatgctggatggtaagctggggacaggggcctgtcatctctggtgtccacaggaagtcaactgaatggctgcatctgcccccattatcatctctgaaacctcagcataaggactagggtttgccatatagctggttctgaataaaatttactgaataaataaattaataaagagattgctccaaacagactgaaggtcccttgagagcaaatgtagacttctgtaaatctgatcttctaacaggaagatcagaatagcagaatactttgtatctaccagagattctctgtatctaacagaatgctctgtatctaacagagatacactgtatctaacagagaccgaaatatatttgttgaatgaagacagatgccccattagcagtaaaaagtaattttaaatccacttacaaccaactggtactatttgtaattcaccctggataggaggatgtatatttccctctttccttcttttttttttttttttttttttttttttgacagagtttcattcactctttttgcccaggctggagcagagcgcaatggcatgctctcaactcactgcaacctccgcttcccaggttcaagcgattctttcttgctttcttaaagccctactcagatataatgaggccttggcctgtactaggtcttccaatttgcattattgatctaaaatttaacttacacagtcaatttcttaatgcaagttatcagaattggtggagaaaaatgtgaattacaactgtgattcgagaacccaccacattataactatatatatatatatatatatatatatatatatatatatatatagatacatagatagatagatagacagacacacacacacacatggcaaatgggcccacatacaacatgttttagaaattgtgatattgcaagtggagcctcacgctgagatctgagattgttcttccatagtctccctgattcccaaacacgtagttgcaatcagactttttttcctaaggttaaaaggacaaatgcttgcaggtatatatgcaaaaatacatacacagtcaatcacagatgaaatacaaaactaaaaaaaaatctgcagaagagaaatggaatttgagtggctttctttttagtcttttctttttatacagctatgataccttttacaaaatatttatttatttatttatttatttatttttagagacagggtcttgctctgtcgcctaggctagaatgcagtggtgcaatcatagcttaccatacattaaaagtatcctcttacctaattttatatgtatgtatgtatgtatgtatgtatgtatgtatstatctatctatctaccttaccayacattaaaatcttacatttctacacgtgcaggactagaatgaacacacataaagcatgataccaatctgcttttttggccaccatataaacattctatgctaaaatgtcaagttgtttcattttacttaaaaaatgtgaatgtgaaatgatttaaacattcaaaaaaaaacttcgaatatcaataatttcacttaaagcttcacatcatatttgattaaaaccaaatatttatgaatcaataaaaatttcatactttcattattacttgtaatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttgtatgtttgstacagacggggtttcaccatgttgcccaggctaggttcaaactcctgacctcaagtgatccacctgcctcagcctcccaaagggcagagataactaatttttttttttagatggagtatagctttgtcacccaggctggagtgcagtggtgcaatctcggctcactgcaacctccacctcccaggttcaagtgattactcctgcctcagcctcccaagtaggtgggattacaggcacctgccaccatgcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggaaatgtgcaattaatggagccatgtctccggaaataaaatatttttaattatagggagaatattttaataaatgagcagctcagcaagtcataattgtcacacaattaacagattttcctacatcatacttacatacagtatgagctgcatttaaatatagttgtttttctgggaaacaaagtttgtgagattttatatatatagtctctgatgttttttaggagaaataaaaaaatattggaaacatactcagttcctgtttctagaaagaaaagaaaatcctatgcaagagagtggctatttgtcccacgtcacataaatgagatagtaccagaatctaagtcttagaaggctaagagttttgaaagttatcaaatcacttttccattcaaagcagcagagcatgagtgataatcgtttcaaatccttccaaaagaataaagaatctgggatctaatttttcttttttttaagcctcccaatgcagaaggaatggagatggaaaaaaccgctgcggtagacatcagattccattccttggttttaattgcgtggttgcagtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattccccgaatccatcaatactgtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaatgtgtcagcctagaagaatcacaaaaatccttctttaaacaatctagtagccagatgaagaccccacgccacgagcctgtatgtggttaagaagttcatggggcgaccccattccttctgattgctgcgaaatgtaaaagacacggcctcaagtccaaagcctaatgtgccattaagagtagactgccttggcctcacctgaagcaaatgcatctagacctgtctgactctttgactcacagtgcaggagattagggattccctgtatggttgttcagtctgtacactgaacaactcagttggtcaacatttacatagactacgaaatgatagagacttctacaggtatgcaatcacagatgacagcttgtgtgattctaaaggggggcgtctgaggcaatctactaccattcaccaatgttctgctctactctctgttcatgtttctgtacatcaaccattcattcagtcattcaacaagtattcactaaatgcaaatgaaatgtcagtctcatccaatccttcaaccaccttatttggcagacactattcttcccattagtcccatttagcaaaggacagtttgctaatgaccctctcctggcctcagttaattgaggccaggagagggtcattacattgcctaggagggtcacaaagctctgtcctccaagtctgagtccagtacatttctctcctggactgagctacccagtttattggagcaaaaatttcctttctcaccaatgaatttaagagtcaagttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctcacttcatggagtaaatgtgtagccttgaatgagttacttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggcacatgccaccatgcccgactaatttatgtatttttaatagagatggggtttcaccatgttggccaggctggtctcaaaccccttaccttgtgatccacctacctcagcctctcaaagtgctgagattatgagattacaggcgcgagccactgtgcctggtcgtgatttactcctttctttgaactttaagttcttcatcaataaaatgagaataataagacctcataaagctactgggaggagtacatggatttataagaactagaaaaatgtctggctattgtggatgttcaataaatgatgggtattattattattgactgttcttgggatgtgttctacttgggtgtgtctctggcatctcaagtgtacgtattttcctaagtggggtgtgtgtgtgaaggaagaagatgcccttcttttgtgcctcgccttccccaaaagacatcaggagagtaaacatgccccctatagtgccaagagagaaaaatgtaaattcttttggataaattagcttttgcagctacctctctctttgctatgacttctgtttctcctctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagctgttctgtaagctcataaacatagtgtgccagaaactgactagaaggacagcagggggacgggggatctgaatgtgccaagacagttatacccttatgggttatggcaaacattaaatggtctagaaaatcagaggccttggaaaagacttgtaaaaataacaatgtgagaacttagcataaaggccaggaacatgaaaggggaagccatgggtggcacatgttggaaactgtgctggaaacacatcctgaactgctcttgcaaagtgaggcctcttaagcagttcctgcaatcctcctcccagccctccataccaggcagaccaagatgtgctcccagcctctgggcagacagtgggttttcaacaaccctgactggggctgaggtatgagaggtgcatatcagagccccaagagggctcttagaaagggaagttggccagatgtggtggttcacacctgtaatccgagcactttgggaagatgaggcaggcagatcgcttgaacttgcgagttcgagaccagcctgggcaacagagtgaaaccccatctctaccaaaaaatataaaaattagccaggcatggtggcagtggcatgcacccgggtgctcaggaggctgtggtcccagctacttgggaggctgaggtggggaggatcacttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgttgttctaaaccgacctttactccttattgccatttgtaatgcatgcataattcaatgctgaagccgagggagaaataaggatgttggtctaagtggccctttttgggttgttttttgatgatttgctataatcctataaataatacaaagcttgtcactgtaaatatgtattgtgttatctagaggtatattcagtggctaaaacaataaaagctcgtctacgtctcctggcaatctcaaggcataattaatcgctggtaagatgtattctagaacgtgagagcccttaagtagaaggaaaaataaaggccattgtcaacacaaatgctaaaagaaatgcctaacgggcatagtcatttgccatctgggaaaagtgtttgctagtgtacttgtttggaaggcaagaaggatgattcaaaagggatttttgttcaggtggtgaagaagtgtgtgtgtctgtatgtatatacatacccacgtagtttttaataaattataaatcaagatgtttaccaagctaacttgtcaattttaactcatttctgttatttgtttacacacacctccatctgacaaatatatacaaaacaatgtatgtgtatgcacatatacatacatatgattttttttaaataaagcataaatcaggaggtgctcagagctagcttctgtccattctaacccatctgctatttgttcacttgcacacactcactgtgcaataaaccctttcaatgtgggagacaagtgcaagatgcccctctttccccaaagggcacctctgtgtgctccctcagatcatagctgatgacatgtcaatgaaacggtgcttgctctcatcccagagatcaaaatgagggcttaacctgcaatttactttacaagtcccatgacacttgccagatctgaagacttcattctaatcttccctgttgaaaaaataatcaaatactccaacaaagatgtattgacaactcttaattaaccatgctaatggagggaagagatagcatggataaatgaaatccacacataacccaaaaccttccttccccattaatttccaacttcttgactaaaccttactgagataagtgggtggggagtagggagaggctgactaatcctttaacgatagaattacttgatgtctacatctgtactatgccaatcagctgttggacaaggtaacaagcaaggaagtggccaaggacaccatgtgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagagacgcctggcacctgtacagagtgaaacaggcaatgctgtgtaacgagcagttgacagcaatgaataagggttgcagaaatggcaaaagagggcaccaaattaaccaaagcctagggaagatgacgaagccagagtattcattaagggaccagatgaactagcatttattgagcaccttctgtttgccagggcatataagaacatactgtgatgaggcaccatgaaatacgacctttgaacagaaactgggtaaaaaacaaaagtaggcttcctcctcctcctaacagcatctagtgcagccacattagatgggaagagccagaactaggcaagttattccactccctgatcctcagctgcctcggttgccatctctgcacctgcagggtgaacacaccccaatagcggtaacgtaagcatacccttagaatgatcctgtgtgggagatgcacctgaatgtgtggtccgggctggggaatccaggagtgaccaacccagagatttgtcccttatatataacagacatctgtgccccatgcctgtcccgtggaacacaggccaaacagaggattgaggtcctgagtttggagttaaatgaagattgccaggtagaggttgttagggggagggtgttaagtgaaggtgtgatataaaccacatgacatttgcaggtggttatggttttcctgcccagcccaccgccaccactggactgtagggaggtggatatcctgtccagcctactgccactggaccatttctgtatgtaaggtgggcagttgtactatccagcccgccatcactggactctctcccctatatgtaacctcctaataaaaccccatgtctatctgttggctctgagtgtcttcttcagctcttgaacctggtgcctttcctattgaggttaataggggttcagcatgacagcacctccacctcccatggcacagcatatgtacccaataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaaggagcagagttaagaatcaaaccccggccatccagctccagaaccgagcttgtgaccctggcatgggtatttccggagctctcgctaatgtgccagatagacgttgtgctaaagaaatgatctgtgtgtgttttctcatttaatatccatacagccccctaaattggagattactactgttacacaaatgaggaaactgatcttggagagggccagtcagctgccaaggtcacagagccagggagtgggggtggcttgcccaaggccaggtctgtccctccaggtgaaggtaatgattaagaacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggctttcaattcttgggaagaaaggggccatataaatacaaaaaatcaagtccgaaatgttgttgaaatgatcattttggtccacctaagtttatacaaaaacattttccatgctctgatctccccacttgcactgttgggtagcccaagttccagatgaacggccttctcacctgcatgctgaaaccagccgaggctgctgccacattaaaaactcagcccaggctgctcctgaaaatgtttctgccctcagagccacgtactaaaaattaaggggattaagggaactctagatttacatttaaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctctggaggcggacttcctgggttcacattcacaacacctccaccgccaccactccatgagcttgggaaagacatttaaccattccatgccttgtcatctataaaacggggcatgacgccagacacggtggctcacgcctgtaatctcagcactttgggaggtcgaggtgggaggatcacaaggtcaggagatcaagaccagtctggcctggtgaaactccatctctactaaaagtacaaaaaaattagctgggcatggtggcacgtgcctgtagtcccagctgctccggaggctgaggcaggagaatcacctgagcccaggaggtgaagcttgcagtgagccaagatcgtgccagcctggtgatggagcaagactctgcctcaaaaaaaaaaaaaaaaaaaaaggccggggggcataagtacttcctcagagggttgtcctgaggactgaatgatgtcatttaattcacattgatatggtttgaatctgtgtccccaccaaatttcgtgtcaaatttatttatttattttttgaaatggggtctcgctctgttacacaggctggagtacagtggtgcgatctcacctcactgcaacctccacctcccgggttcaagcaattctcctgcctcagcctcctgagtagctgtgactacaggtatgtgccgccacgcctggctacatttttgtattttagtagagatgaggtttcaccgtattgtgcaggatggtctcaaacgactgagctcaagcaatccacctgcctcggcctcccaaagtgctgggattacagagtgtgccaccgcacccagccttcatgtccaaatgtaatccctaacgttggaggtggggcctggtggaaggtgattagatcatgcggacagatttctcatgcatggtttagcacgtatgctgtgtggtgagttggctctcctgagatctggttgttgaaaagtgttttgcacctgcccccttgctccctctcttgctcctgtttgcaccatgtgagatgctttccttcccctttgccttccaccatgattgtaagtttcctgaggcctccccagaagccaagcaggatgctagcatcatgcttcctgtacagcctgtggaactgtgagccaattaaaggtgtcttttaaataaattacccagtctcaggtatttctttatagcagtgcaagaatgaactaatacacacatagaggatggagcactctgcccagctcatgccaacactccatcaatgttagtacttagcatcagcattatgttgcatagctgatgattcatatacacattactccctgcaatcaatgcccaagccttgcaagatatgtgcttcaatccccactttacagagggctatggatcgccaaggctccacctgcagttgggttctacataagtgtcctctttcctcacatcttcagtaaagtatgagacctccatcaatgcctgcttgggtgaggagcacaggtgggtgaaaggtaagggaacaagtggaactccatatccaaggtaggcacagtgtggaccagaagagcatccctaggacagtgaggtgatccacggactgacctgccccaaggccagagacgcaggagtggaaagtcacatggaaccatgagcttttataaggggcagggggcaggtgttgggaaattgcagaactagtgtttgagcagatgcaacagatccgaaggaaatagagattgcagttgaaatctgggtccaactggccctatcagctgcattcatgtgttacctccctggtcagctgtaccctccttcaggattaggactgcatccttaccaatgctgagtcctctgggatccccagaggcatcttttgcacccatggcaaaaaaaagaaaggtgggcagcagcaatgagaaccatgtccactaggtgcaagtaataacgggtgcattgttcgctaaggacttaaaagtattaataaaagtgaccaaagtttaactgctttttatcatcaccatgcttggtgattccaaacaatgtcagtgaaaacagattcctcctgctggcaggggggcggccacacccatcacaccccctcttggcaccgccatgattttacacactgcactcaacaaatattctctgaagggctgaaaaaaagggggctggggaagggcagaaatcctgttgatttctgagcagcaaacacgtaaacataactgacattaagatatacaaaatacatctttcaaggaaagatgtgccattctttcttgtgtgaaataaaaacacctccccatgcaagattccaactgcacagactgatactgctatggtctgactggaaacaggacatcttgcattcttgtggctccgaaaatcactctggggtccaaggatttatttcctctctcgggagtcagggacagataataaatacccctcatcagctgatcaattgctcgcacttccaggcaagcacccakcactccccaccaaacacaccgccccacgccacctgaacraggttaaaagaacggactcatgactgatggtcggggggaactggcttcagaagaggaagttgaaaatattaagaaatcaacacgggcatttaaaagcaaagccttttccatgccacagaagacgttttgctattcatcttgttccctgactctgcttcaccaacttgatggaagatggtttaactgacataaaaaccagctatacatgaacagcggtgattgatggaaccattccaaacatcagccaaaaatggcactgaaagatgccttgggcttcctgttaactgttttatgaggggaccaacaggtttcccccctcttctttaaagaatatattagcagtacaagtactttcaaaaacagggtagtgttataccaagagagaaacagaaggggaaaaaaaaggtaggaggtcttttgcatgttagtatatgtatgaagggagttaggacctggcaaactgggttatatgaggctttttccatacacagctctttggtttcacggtacatgatttaaataggttgtatttaattccatgtaataacaaactgtgccattaagtagttctcctgtacaaatgcaatgtttcaatggcaacagaaagaaaatccagcctttaaaaaatgcacagatgctccaaatgagccatgataaagaaaggggtggggagcgggatgatctgcaaaaaagaatgagggaaggcagatttgtaccacttgtgctaaagcgtggagccttaccattcagggagaatgagacgtttgcaaaatggcatcctagtctttgaatgcttcttaatatggaacggacgagaacagaggtggcaagagggttagaattccccctctttgttctcctttctggaatggagaggaccttttcctgcctttctttgctcttattttgaagaggttaattatgacctggaagcgcccaggcacttgggtctcagctattgtcgaggaagaatattgtctgcgctgtaccgcaagaactaacttaggaaacattcaaatttggaactgctttcagaagcctcaggaccgattccatgtggtggcattctatgggatgacaaatccccactccgttcccactacttgtctttgaagacatgcacattagtgaggcagaaaattcactcgactttaaaataaaataagctggttatttggcccatctagaatacattcgtatctcaacatttcaaatcaaaaggcccacttattcctgtcctcatcctggctctgaagccaagctcaaggtgctctcaattacatggtagatttctggcccaagttaatatgtatcaggacttctcaagcgtttgtacctttgacctagaaattctacttctggcaaatcaatcccatagaaataattttaaatgggaaaaatgctttagaaccaaagatgttcgtggccatggaaatgacgactgaaaagagttagtgacaacctaaaaatacagttagaaggagaatgatgaactaaaccgtggttcctctcattggtttactaacatgtccccattcaaagcactgttcaggaccgtctagaacaacctggaggcatgcttttaaaatgttaagagagaaaagaaactattatccatatgggataattaacaatgtgttaaaaatatacatatctctggaatatttgaattgcaggaggagaattaatttagagataacaagcaaatccatcacgagtacatatgccacaattgtaacaaaacaaaataaaacaaaatggcctgggcatttgaaactactgtaagaatatgtgccaaaatgctaagagtagatatatattggaggattttctttttcaatctttttttcaactttggagtattttcccttttttatgaatatgtccctattgtgtatgagaaatagctaattttaagaagaaacagaactccaagggggaaagaaaacacttttttttgctcctatgagaattcactggataagggctgtacatttcgggcccgcctacttcattccacaggaattagtaactgcaggtgcaagtgttgctactgctcgaaggctaagccctgataaggcctggggaggcccagagactaacaaatgggtttcttccaggactttgctgctgattgatcactgcacttaatcctttccagagatagttactcaaaaggaccaggaaaggtaaatttaccaacgcaggccaacgtgactaaaaatagaaccataaaaatcttggggagatgcaatgtggcaagaccatggtcttcattaaggcagggctgaaggtggaatcctattccagatacttcacagcttagatcttttgccaagcctctcacagtctcaaattccccatcatcagcaggagtcataacagattgcaaggaggtttaaatgaggcaatacatgaaatatgccataaacggcaatttatcagcatctatgatccctaacattaaacactgaccacttccttatgtgccagacacaaagctgagcacttcacatgtactgcttcacatactccgagaattattttatttaacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctgagccgcagtgaagggctttcagaggggcagtccacactggacatcaaacggtagagtggagattgggtcaaggacaggagcttcattatcttaaatgaattaatgcgggaagagaaaaccaactaccacatgttctcatttgtaagtggaaactgagcattgagtacacatgcacataaagaagggaacaataggccaggtgcggtggctcacgcctgtgatctcagcaccttgggaggccgaggcaggcagatcactcgaggtcaggagttcgtgaccagcctggccaacatggagaaacactgcctctacgcaaaatacaaaacttagccgggcatggtggtgcacacctgtagtcccagctactccggaggctgaggcacaagaatcgcttgaacccaggaggtggaggttgcagtgagccaagatggtgccactgcattccagcctggaagacagagtgagactctgtctcaaaaaaagaaggaaacaatagacactggggcctactggagggtagagggtggaaggagggagaggaccgaaaaagcacctattgggtaccatgcttctgacctgggtgacaaaagaatctgtataccaaacccccatgacatgtcatttacctatttaacagccctgcacgagtaccccagaaactaaagttttttaaaaaatgaaaattaataaaaattaaaagaaatcacagatgtttgcatatcacatcagttactgcagatatttcaaaatatcatttacactcaacactactcaaaagtataggtgttagtagatacactattacctcttgtgatttaatgtactatagaagaaacgtgtattactatagaacaataaaaatgttgatatttgtatttcaaaaacaaaacaaaggaataagggcttccaaactttaaaatgcaagagagcatcatgggatgacagtggaagaatggacctgggtgagaggaggctaggatggggagagggaagggaaggctcacatgtctctttttttgtttttggttttttttgagacagtctccctctgttgcccaagctggagtgcagtggtgcgatctcagttcactgcaacctccacctcccaggttcaagcaattctcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactgtgcccggctggctttcatatctcttattctttctgcttccgctctctcctgtcccctattagccatgggttccagagaggagagaaggctcgggagagcaggggactcaggaggtcaccctgctaccctcacctttttaataaccctcctcaaaccctggttccacgtctccctcactcaaggatttatgtctcattttcaatggaatgttacatttggtcagaccacgaagaaaactcctcattatraactaggaaatgtgtggagagagaattatttacccaaggcagtgctcaatcagtgttgcccgaatatttatttagcccacacacggagaagttgtgttaatgtttgccaaagaatgtagctttataaagtaactgggtcaaaaaagacagcatatcattttacaaataactttaaaattgcttaagttaaatagctgggctctctcaggtttgtcttttcaaaaacgctgcagaaacaatatccagaattatgtctaataaaatacaggtattacaaagtggctgtttagcccattaaagaaaatggagagtgaaatctgaattatttctacccgaggcagaagcagacaaagttaccaaaattatgttaggccgacgtcgcaattcttcaagtctgcagggcggcaaggctaacagctcctgcaccaagactctattaggagagctgtatttttcagtcaacaatgacaggcattccatttctcagcctcaaatctagtgtagctatggggaattcacccaaaacatttgcttttgctttatcagtggcatttgtctgcctcaaaagccttgtgagggagagggctactacgtgacgctgccaggcaatgctgttggaggcagctgatttgatggacaagaaggggagcagtgaccacctgggtcactctgactccgccctctctgagccaagtgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatggtagcacatgcctgtagtcccagccactcaggagcctaaggcaggagaattgcttgaacttccccagcttcaagaggaagagtctgcagtgagccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagcaacaggaggaagcagaccaaggagggagagaaaggaaggcagagaaggggaaaaaaaaacacaaatgataataatagatgctgacatttacggagcacttactatgtgctgggaaccatgctgacggcacaccgaatccactgaacaggtgggtaagtatcatgggtcaatatcattctcattttaatgttgacagtcacaagactttcatctgtacaatgggggtactgctggctcccaaggccagtgttggtggaatacagtgaatagaggtgagtaccgtgtgacaggaggctgcatcagtaagcaggggcagccagccaggtgaggaacatgcccactgagatggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatatagatccttgcacctgcaatacctgcctggcccagcctggccctcgcaggttcttgtgaaatatttgcttatgagtaagcaaatgcataacacgagacggctgctctggaatgacagttgcgaacacaggaggctgctgagacttccagagactgtagataaagaacaaagaccctgtgaagttcctccgggaaaccagatgtggcagtgtgctagggctgccctagcgtatcagcacaagctcaacagaaactgactctcacagttcaggagaccagaagtctgaaaccaaggtgttggcaggggtgactccttgtggaaaccgtgccaggtttctctcctcgtttctgggggctgcccatgaccgtggcatctcttggcttgtagacgcatcactccaatctctgcctctgacttcacagagccttctcctctgtgtcctctcctcctttttctgttttgtcttttggtgttattttttttttaagagatggggtcttgctatattgcccaggctggcaatgaactcctgggctcaagtgatgccccctccgcagcctcccgagtagctgggattgcaggcacacccaccactgtgccccctgctttcctcttctcatgaggataaccgtcattggatttagggcccactctaaagcctgaatgatttaaccttgagattcttagctaattacatctgcaaagaccctgtttccatataacgttacatctgtgattctgtgtgggtgtggattttggggagacgctattccacccactacccttacactgcaactcacccacactgacagcttcccttgcctgtgtctgtccaactggcttagaaccggagcatggcatcgtcaccatggactttgagaatgtataaagacaggtgcctggtcccattccctgtgagtcttgaggaaaaaagaaaagtgagcttcaaaaactagaagagccagcctggtgtggtggctcacatctataatcccggcattttgggaggttgagactggcggatcacctgaggtcaggagttcgagaccagcctggccaacaagtgaaaccctatctctactaaaaaatacaaaaactagccagacgtggtggcatgtgactgtagacccacctactcaggagactgagacaggagaattgcttgaacccaggaggcggaggttgcagtgagccaagatcgcgctgctgcactccagcctgtatgacaaagcgagaccctgtctcaaaaaaagaaaaaaagctagaagaaccaaatcactaatgcctaagcaagaacagaggggatagaggggcctgggaagcaaggcctgtaagatcccttgacaataacacaccagtcccatgagcaggaacacaaaacattatccctggacccagttctccatcagggtctcagcatgaatgaggctcttccttcctcacggggatgggaggaccaccctgctttctttgcccttcccaggaggaagggaacagcaccttccccatctctgccagcatctgtccatcaagagctggtcaacagcttagactcaggggatgccacagtccacattacagtgtcactgggccagggctgggagaagccgtgggagaaatgcagaatggggaggctgaggcaaagtcaggatgaaccaaaatgtaggtgagcaccagacacagtggccacctgaggaggaaacacacaacagctgagaatccacgggggatgcgtggccaggttagagcatcctggaatcaggcaggtacgaggagtccacgaagtggagaggtgatgcaaatctgcaggccttggggacaagagcacatcaaacccttgggggccgatgccttcagtattcctaattcctccatgttagaaaggtattttgggccaggtactgtaatcccagcactttgggaggccaaggtgggcagatcacctgaggtccggagttcgagaccagcctgaccaaaatggagaagccccatctctactaaaaatacaaaattagccgggtgtggtggcacatgtctgtaatcccagctactcgggaggctgcggcaggagaatcgcttgaacctgggaggtagagatcacggcragccaagatcacaccactgcactccagcctgggcaacaagagcgaaactccatctcaacaacaacaaaaaaagtaatttagcacatatactgcatattacaaaatacctttgcggggtttggggcaacatcctataacaatgacatttctatttcttcagtgaaaatatgattattcagcctggccaacatggtagagaaaccgcatctctacaaagacacaaaaattggctgggtatggtggcacatgcctggagtcccagctacttgggaggctacagcaggaagatcgcctgagcccgggaggtcgaggcttctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggttttggaataacaaaaaagggactgtacatggatatttccaagctggaaccgaggcactttctagacgaaggcagccttatccccaggaggtaaggtgtggaagtgagttgagggttgaggccagcaagactcagaccacagcctcctgctccaaacagccacatcacttaatctattttgtaaaccaggcttccctcaagggatctggtttaatgagagaatttgggagctacaaaaaagactgaaaattgttgttggacatcagatgctggcaaactttttttgtaaagggctaaatagtaaacaacttaggctttgtgagccaagaggcaaaaccgaggctattacagaggtatttacataacaggagagaaaaacaaatttctgcaaattttttattgatgaaattcaaaactttatgacactgaaatcagaattccatatcattttcctccttcaagaaataatattctcctctttattcttttttgcagatgattgaaaatgtaaraactrttctgagcctgcaggccatagccaaagaggtaccggctgtattttgtccatgggcaggagcttgtgactgctggtctaggtcattccaggtcaaccaggggcctctcccagagtgagaaccactggtgattccccagagtgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaacaatagattaaaaagtgcaatatttttaccccctcttaaattggaatcatggtatagcaggcaggatacaaacttctcatttccrttacacattttcagtgccatcattaatctgaatgayatcaacaaaatgcccaatgcacataaatcagtcagactttgaatcattcctgcagcctctgaacatttaccatggagctcaataagccaggcaagaacacagatttttttttttttttttttttttgagacggagtctcactctgtcacccaggctggagtgcaatggcgtgatctcggctcactgcaacctccgcctcctgggttcaagtgattctcctgcctcagcctcctgagtagctgggattacaggcatgcaccaccacaccggctaayttttgtatttttagtagagatagsgtttcaccatattgatcaaggtggtcttcaactcctgacctcgtgatcctcccatctcggcctcccaaagtgctgggattacaggtgtgagccaccgggcccagccgtaggaacacagatattatcatcatgggacaagtcatccattcycagattccatgaccctctctggtgtccactgtggatttcagcacatgtttaactatgaaactctagtcacgctttttgatatacaggttcatggttactagtgtcttatcctgcttgagccaagaatatgcactaacacattagacaaaccttgaattaaaatgggcaacccaccatccaaatggggaaagatgattacagacaagttcgtacgagtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctcccaccatcctttgtaagtatgtataaggaggccaggaaactagcatttgctgagactttattctcagctttgtatgctttgcataaatgatgtcatagaacacattgacagtgagaaaactaacgtattaacattttaattaccttgccctatcacgagattagaaagattcagatatgagacatccaaagtctgtgatctgaacaccagagtcagaggctggcaacctatggcccacgggctgaatctggcccactgcctgttcctataaataaagttttattggaacacatccgtccatttatatattatctgtggctgctttcctgctgtaacaggagagttgagaagttgcaacagagaccataaagcccacaaagctaaaaatattgactatccagccctttagagaaaaaggccatgcccaggctcctgtgggtacctgctatgctacagcccctctgctgggggaaaccagcccactcacaggttcccagtgaggcaggatctctgggcagttccttagtaattggtggctctgtgacttccttcccccaatcaccttgaccatctagtctggacaatatgagcgcccatgacgtgaggacagccttgtaaacagggtggcctggctggaaagccttgtccaaaaggcacaacagtgactacactgaacccatcccatgcatccttttgagagttagaaggaggcaattgcaagccggctgcaaaagaaaaaagacaccagagacttagaaaccagtgaagccacgctgaagatgcagacagagagctagagacaaggtcaggggcctctgttgcactccagacccggtccggaggcttttccatgcttaggggcaaggattgtcagggttctgctgtccctttctttaacctcctttatgattccccaagagcatcctgagtgcacctccactccctgccaccaggggtcagatgagccggcctggcaggcttgtttccctccaccagacaacagcaaggaccaagattggcaaagtgacacatcctctccaaaagaagaacatgcagaacaaatcaaagaacacaaaccacgactgacaaacacagccacactcgattttaaagtactgagctgtttgaagaaaggaagcatggcaaggccccttcctactaataacagtaacaacaataatactaaatattttataataattttaaattcttaattatttatgatatttccctccattaacatcacgaacatcattacgtgtgtgtgtgtatttttctcattttaaaaccagcagatgagagtaaaggatttctttttcctctcccccacctctttacaggacctactgttaagttttcaagaccacccagaaagaaatttgaagttgggtttatatccttaatccctcagttagaaaaaaaagaaaagtgaagaaactgcatctccaagatcctgctatatcaacttcagttttttgaagttaaatttgatttttaaatcccttggctgatgagacctgtgtgggttttttttttgttgtttttttgttttgttttgttttgttttatcattgtacctctattttaaaaatagagacttgtggttctttttccaaaagcagtccaacagaaagtgaatggtggtcaatgcataataaaatgagagttaccttttgacttggaagaattattagcattttgatttgatgggttcttagctcttcaaattcaaaaataccttattcaagtctaggagttttgcaaatacttcggttctaaagattaccctttttcgatgctttgaaaactaaaagggcatatcagaatagaaatctggctgttgaataacttgtaagctctgcagagacgtacaaaaacatggccactttagccagcagtgtggcgaaagtctggggcccacactacacacacacatatgaacttctcatgaccctcaagtatattcacatgatatatcacaaataccataaagcagcattgtaattacagggaggaattgattttaaaaggcctacatcaaaattaatagtcataaaagtataataacctagactggaaaatttagggattagagcattttgaacattatacctcaaatttataaaggctgtatattagcattcacaaaggtttttaaagatggaatagctatgtacacagtgaatttattctaaaatccagactcaaaaaaaaaatgaatatgaactcctccccaccgtgttctggactaaaatcaataagttccctttaggtaattaaaatgctggtcccacgacctgccatcctattcccaggcttagaatgttaggaacactgtttctgctttgagaatggaagagagcaggttaccctgatgcctctggggccaaacacaggggatacattttcccagtagaagaaatcagccctgatcctcaagaagaagaacatattggcatattttagtgagacggaggcatactgcatcttggggtaaaaactgaatcatcaggccaggcacggtggctcacgcctgtaatcctagcactttgggaggccaagacaggcggatcaccaggtcaggagatctagaccatcctggctaacacggtgaaaccccatctctactaaaactacaaaaaaattagccaggtgtagtggcaggcgcctgtagtcccagctactcgggaggctgaggcagaagaatggcatgaacccgggaggcggagcttgcaatgagccgagatcgcgatagtgcactccagcctgggcaaaagagcaagaatccatctcaaaaaaaaaaaaaaaaaatttaatcatcaaaggaaaatgtttcaaattctagggtaagctgacatggtacacatatacagcgaaatacacccagggaggctgaaagtccaataggccaccacagcacgttaaaaatgtcctgttttacctatagtcaacaataataataaattatatatttaaaaatttgttaaaagggtaggtctcatgttaagtgtttttaccacaataaaatatttgtttaatgtcctctacatggctattatgattggaaaaggcataccttgaacagagatgaataaatctgcatatctgtgaaatgtcagttcagcatgttgatcgtcagtaatcttttcagaacatttcagatatatgaaaatagcaccaatgtctgagtttgaacctgaactggtttcagctaaagtgatcatcttcagccaaaataatgggtatttctttcttggccttccttctacagacttctaaaagacagtggaagcactgaatatccttttagaaacaaacaattacaaattagctgggcatggtggcgcacgcctgtagtcccagcaacttgggaggctgaggcaggagaattgcttgaacccgggaggcagagattgcagttagccgaaatagcaccactgcactccagcccggtgacagagcgagactccatcttaaaaaaaaagaaaagaaaagaaaagaaagaaaaagaaaaacagctacagatattcattcctttttaatttcttgataaataatagaccagtaagaatcacataagaagcagtctacatttttcaaagagtttttacagatcccatttgatcttcaaaagggcctccattaggaaaaactaaattcaagtttaaaactatccattttatttctcccataaaaatatattcagcccctggagataatctccaaattcctcagattttaaaagttaatttttcttatcttgacccaaaatctgtagaaacaaggatttttcaccaacagtgagctcccttttcataaaatccttatctaccaagatttacctctgcaaacctctacagtccctggttgtgagcccctgatggaagaagctagcataaagaagttcacaactactggggagggaacgacctgacaagttgcaagcaagaaaggagtgaaaaactgagttaattgtacaagaatttgtgtatttataaatgcaggataaataagatcacgtagaaactctctttagacttccatccttactgctgtaattgaacgaacagacgaatgtgtttgaccgcaattgccctaatactatttttcccataaatacctgaaattcttcaattgtaagttttcctactctggcaattttaaggaaagtgattcttgaggctgtgggtgaaataccacattcattttttttaaaaaaataaggtatacttacttgtactttctaccattttatatatattctctgtttaaattgtgtagcccctaatagactgcaaagacaatgataaaaaggaacttgccttattcacaggtacatccttggaacttagtaaagggcttaacctccatagcaggcagtcaagacttactgaatgattaaataaaaacactgaattccatattgtgcaggaaaaaaaaaatcaagattagacctcagaaaaaattgacatgtctagtagaacttactatctgggcaaacttgaagagaagtgcaatgggaaggcctcctcaaaaaagacattgaaatcaagatgggacccgttcctaccctggatttctctgaatcagctactccttaagttcgtattttgttccactcagccaatggcaattccaggagagaggcaattgataataattatgttttctgccttctcttgggttatgaatttatcatgatgcaaaagtcgagctactccgatgccacgttaacaatgaaaaacaccataaagacaaaaagaaactgaatttaagcatttggattctgcagaggagtttattgaacagattaactaaggaaaggcaaagctacacaattatggaaaacaggtagcaacactcaggctgactattttcgatggccacctgagagcggatttccaatgccctcatttctgtaggtacattatcctgtgttttattgttagtcacagctgcaagttgattaatttgcattcagaaattctaagtggcaaatgtgcaatgcatagtaatatacatttttttatggacactgtgaaaatgccgaagccacatctcataagtaactcttgctcaaccagtgagtaaaatccataaaagagtttgcaaaaggctttgaaagagtttggtttgaaaggaaaactgcaagagcaaatccctctcctccaccccagcccttaaaaaacaaaactaaactaagtctgaagcaaaaccaaacaaagagaacagttgggtgatgtcaagctgccagaatcataaatgttgtcagttcacgtcccagtcttcctgctctcttggcattgccaataaaatccagaaacaccagggatgactcagtaccacagtcagtgcgtaaataagggataaagatacctgttaaatccattgcctcaaagcaatcatgggagtttcttaagaatactgaacctcctctccgttttctgcactaaagagataaggagtggcatggagaatctaaatgtgtggaaaatatatatcattggtgtgagaacacatattgtgataggtgttcccctccatcagccccctagtctatactcctagctgctttatcttccagatcatgcctcccctgctcaaagtgaatttgccttccctttcacactgaccttagaagtggatctgagaccatgcttcctagcaggagaaaacaacttttccatttgaaaacctttgcgaattacccacaactctgacaacaggtgctcagcagttgatagtattctttttggaaagttttatcaaccacttaagttaacttgaagacgcctaacagcaggatatggtcaagcaaacatgttcatcaattaattcaaatgcaattttagtttacttttatatgatttcccatgcttaaaactactaattgctttcccaggctggctgcatgaacatggcccaatcaaaggatgcaacagtcaaatgcttgtgtacatcatgttacctgtccatttccatcagagacatcatggacacagctgaaatactaggcctggccttttgtaagttcattagagcatcacaaacataactgcagctattctcactgtttgtgactctgtgattcaaatgttttcacaaaccttccctggcactgcgtattagatggattgaaagatgctgaaacgtaaggccgggcacggtagctcacgcctgtaatcccaacactttgggaggccgaggtgggaggattgctagagcccaggagatcgagaccagcctaggcaacatggtaaaaccccatctctacaaaaaatataaaaattagctgggtgtggtggcatgcacctgtagtcccagctactagggaggctgttgcagaaggatcgcttgagccccagaggtcgaggctgcagtgagccatggtcatgccactgcactccagcctgggtgacagagtgagatcctgtttagaaaaaaaaagaaagaaagatgttgaactatacacaagaaatgaaaagaaatagctgagatatggctcttggggagaaagaacaaagcatcaactaatagaattcagaaagaaaaggaggtactcatcaaggcactctgctaaggtttgactaatgggattccacatggtctgcatgtttatggcttaaatgagctaccaacactgaaactgtccacttaattagcccccaaaacaagaagtacagactgtgagtctgagacctacagagactccaaaaacagaaactaccatcgcctcaagctaatcactctaagtcctagaaatacatctgaggttgcaaacagtccatttcattcattattttatatatatatatatatatctatatagatatagataaatatatatacagatatacatatagagagagagagataaaacagaaaaaatctaaatgtctaaaggaccagatataagttaatcataaaacgatgacaacaaaaacaaaggcttcttgagttaaaaagaatggaaaatatttaactagagttaaaaagaaaagcaatttgatcaagagtcaggaattgtaggttctagtcctggctctttttattctttttatttattcctgttttttttttcattt
